United States Patent 12,258,632 (METHODS AND COMPOSITIONS FOR DETECTING ESOPHAGEAL NEOPLASIAS AND/OR METAPLASIAS IN THE ESOPHAGUS) - sequence listing, part 3

SEQ ID NO: 10276 - DNA, 201 bp, Artificial Sequence
  Description of Artificial Sequence: Synthetic polynucleotide
ttgtcggggagaatatgtattaggtggttgatggttttgtggatgtggtggtttgtattttggtgttgtgttttgtgaagaattaggagcggatttttcgcgaggtgtgtagagtgttgagatcggtgagtgaaagggtgtgaggaggattagttagtagtagttattattatagagggtaggtttgttaattttaggtgg

SEQ ID NO: 10277 - DNA, 201 bp, Artificial Sequence
  Description of Artificial Sequence: Synthetic polynucleotide
gaggcggaatttaacggaagtgaagaaaagattaacgggaaagaaggacgagtacgcggtttcgggatagatttttaaagtttttttttgcgttttttggcggtcggagggggagtagcgcggatacgtttttcggttaatcgttggttattaggttggagtggggtttttttttgttgttttttatgagattattgtttt

SEQ ID NO: 10278 - DNA, 201 bp, Artificial Sequence
  Description of Artificial Sequence: Synthetic polynucleotide
gcgattacgggtttcggcgaagatgcgtcgtttgagcgttcgcgcggttttcgttcggggcgggcgtgatttttgttgaacggagattttttttttttttcgatttcggacggcgtaggtcggcgttaggatagtttttatcgatagcgtttttttttattcggagagaggtatcgatttttaaggagggtttcgttaggt

SEQ ID NO: 10279 - DNA, 201 bp, Artificial Sequence
  Description of Artificial Sequence: Synthetic polynucleotide
tcgttttcgtcgttcggggtaggcgcgtcgatggcgtttttgaggtgacgtcgtttatatcgggttttttcgggggcggaggaaatatttatgaatttttcggtagttttttttgtcgggcgttaggtaagtagcggtttcgggcgcggcggggcgtcgcgggaacggtgtatattggtcgaaatttattgttttttaaga

SEQ ID NO: 10280 - DNA, 201 bp, Artificial Sequence
  Description of Artificial Sequence: Synthetic polynucleotide
ttcgttatttggggcgtttggggggttttggggcgggggaggcgggggttttgtttaatttcgttattgttattatcggttaggtcgcggtttggtaattcgtgaataggaggtagggttgtagggcgtgagggatgatgataaggaagtcggaggagtagcggcggtagcggagagtttattttggatgtaaatggtagg

SEQ ID NO: 10281 - DNA, 201 bp, Artificial Sequence
  Description of Artificial Sequence: Synthetic polynucleotide
atttcgcgttttgcgttttaattaggattgtttcgcgcgtttttgagtttcgggtttcggttcggatttgtagttttttaggtggttgggaaggtaggtgcgtcgttgttttcggcgcgcggcgtttcgcgaggtttttagttttcgttttggtggattttcgttgggtgggagtcgggagtggaggcggtcgttttaggg

SEQ ID NO: 10282 - DNA, 201 bp, Artificial Sequence
  Description of Artificial Sequence: Synthetic polynucleotide
cgattcggtcgtgagcgtgtttcgttgtagttcgttgttcgttaggttcgggtggtagcgtaggatgtttttttggtttgcggagaagtatagatatcggcgggagcgcgttaatcgcgttcgtttcgtatcgcgtattcgagggggcgcgtaggtcgcgttcggtttttttgtttcgtttcgtttcgttcggttttaaag

SEQ ID NO: 10283 - DNA, 201 bp, Artificial Sequence
  Description of Artificial Sequence: Synthetic polynucleotide
cggtttgggaaggtttcggtttttcggttgcggttttagttcggacggcgtcgcgtaattttgttatttttttggtttagtttcggttataggaggatttcgcgggtaacgcgcggagtttttggtatttttcggcggtgttttttgttgtttgttcggggatcgatttcgtatgtttttaggttgatttgtttaagttcg

SEQ ID NO: 10284 - DNA, 201 bp, Artificial Sequence
  Description of Artificial Sequence: Synthetic polynucleotide
gtaatttcggcggagtcggcgtttttgggtatttttggttttcgcgtttcggtcgtacggtgattattcgggaggggatttcgggcgtttcgtaatttttcggttttcgtgggttttcgggtcgtttcgtttttcgtcgtcgcgtatttttcgcgtttttcggttttcggtgtcggttttcgtttcgcgtagtttcgagtt

SEQ ID NO: 10285 - DNA, 201 bp, Artificial Sequence
  Description of Artificial Sequence: Synthetic polynucleotide
aggaagttcgaggtcggggcgttattttaagggttttttcgtttttttttcgagggtagagaggcgttcgcgttcggacgtattgcgggaatatttggagcgtcggcggagttcggttgttttcgcgggagggagttcgacgcgtatttttgggattcggattcggcgttcgcgtttcgggacggatttttgtttcggttg

SEQ ID NO: 10286 - DNA, 201 bp, Artificial Sequence
  Description of Artificial Sequence: Synthetic polynucleotide
tcgtttgtaggttgtttcgggtcgagtcggagcgacgttgtcgcgtatttgggtagttttcgggggtcgcgttgtgttacggtcggggtcgttgcgattgcggcgtttgtatttgttacgtgattgagtcgggtatgtttttcgggtttttgtgtgagtgttatgagtgggtgtgcgagatttacgacgggagtatttgtg

SEQ ID NO: 10287 - DNA, 201 bp, Artificial Sequence
  Description of Artificial Sequence: Synthetic polynucleotide
tacgtttggggcggtcgggggcggggtttggttggaattgacgcgtggagtttcggtggagggggcggggtttggttgggtcgttgtttatagcggttttcggggtttggaggttacggggttcggaggttacggggttcggaggttacggggttggttgtgtggggggtttaggggcgtagagtggttaagtagcggttt

SEQ ID NO: 10288 - DNA, 201 bp, Artificial Sequence
  Description of Artificial Sequence: Synthetic polynucleotide
ggttttgtagttttgtagcgttcggggcggtgtaggagtttcggggtgtcgcggcgttcgttcggttgtatcgttggtttttcggttcgggttttaggttcggcgttttttatttttaggtcgcgcgcgtttcgttttttcgacgatttttagtttcgggttttcgttatttacgagttttcgttttcggtgagttgttgt

SEQ ID NO: 10289 - DNA, 201 bp, Artificial Sequence
  Description of Artificial Sequence: Synthetic polynucleotide
gcgttttcgggggttgcgtcgtgtcgtttgttgtgcgcgcgtagaggtcggatagttcggttgcgggaagggattcgagcgtagggtttgtttcgcgtttcggaaagtgtttagtttgcggagtcggaggttgagttggggtagatcggcgttagacgggggtttgggtgagatacgagttgggggtgcggtttgtagaat

SEQ ID NO: 10290 - DNA, 201 bp, Artificial Sequence
  Description of Artificial Sequence: Synthetic polynucleotide
ttttttttattattttttcgtttttttattttttttttttttttgttttgtaggattgagtagttaggcgcgagcgaaaataaatagttggggttgcgagcgttttcgtttcggtttcgagagtacgtcggtttagttttttatttggggcgttcgtttgtttattatgaggaagattcgcgttaatgttatcgttatttt

SEQ ID NO: 10291 - DNA, 201 bp, Artificial Sequence
  Description of Artificial Sequence: Synthetic polynucleotide
gttcgtgtcgttgttgttggttttagcgttcgggttttcggtgagtgcggttttgtttcggttttcggaggaatttgtaggggagtcgggggcggggacgcgcgggttcgtaggtaacgtttttaggaaaggggcgatgttagggaagttgggttgggaggaggcgagttcgtatcgttgagtttttttagaaagggttgg

SEQ ID NO: 10292 - DNA, 201 bp, Artificial Sequence
  Description of Artificial Sequence: Synthetic polynucleotide
cgttgggcgtcgttcgtcggtttaggcgcgcgaatttggcgtttttagtgaattattcgcggttcgggcgttcgggttcgggatcggtttttttttttttcgttgagtcgcggtcgagttggttttttgtattttatttagcgtcgtcgggacgcgattatatcgagatggtatcgagttttttttaaaggtttcggtttg

SEQ ID NO: 10293 - DNA, 201 bp, Artificial Sequence
  Description of Artificial Sequence: Synthetic polynucleotide
gttttagtttttgggtcggaagtttttttttttttttcgtcgtagtttttttttagttttttttttttcgtcgatgcgggaaatttttttcgtttcgtttcgttttttttttttagttgtattttcgttcggttttttcgtttagtttttaatttaggtttcgtttttttttatttatttttcgttttgggtcgggttttc

SEQ ID NO: 10294 - DNA, 201 bp, Artificial Sequence
  Description of Artificial Sequence: Synthetic polynucleotide
gatggcgacgcggatttgtatcgtcgttttgggttcgggtcgagttttttcgtcggattgggttatggttcgcgggattgcggcgtcgtcggggtttttacgtcgtaaggtttagttagtcggtcggtagcgattgcgacgagggggcgggggcggtgcgagcgcgtttgtcgttcggtttaggggagggataggggtcgc

SEQ ID NO: 10295 - DNA, 201 bp, Artificial Sequence
  Description of Artificial Sequence: Synthetic polynucleotide
gtttgtttcgtcgttcgggttttgtggttggttattcgcgagttcgtttcgttttttttgtttcggttcgttcggttcgtttcggggttttcgtcgtaatcgagcggagtttagcgattcgtcgggtttatattagcggtcgtttttttcgaagcgtttttcggtagcgttcgggttttcgcgtttcggaatatttatgaa

SEQ ID NO: 10296 - DNA, 241 bp, Artificial Sequence
  Description of Artificial Sequence: Synthetic polynucleotide
cgcgttggttcggtttttagttttttcggtcgtcgtttttcgttcgtcgcgtcgcggcgttaggagggcggggtcggggcgcgcgtcgttttttagtaagcgggcgggcggcgttcggtttgagggagcggggcggttttcgtcggcgtcgcgcgcgttgtgtgtgagcggggtcgcgcgcgcgcgcggtaggcgagtgagggaacgaggagcggtcgggtgtgagtgtgtgggagtgaga

SEQ ID NO: 10297 - DNA, 201 bp, Artificial Sequence
  Description of Artificial Sequence: Synthetic polynucleotide
ggtgttaagcgtggggcgcgggttcgcggcgggagttgttcgcgaaatttagtgttgaagtaggcgcggacgtgttcggtgtttggcgcgtggtagtaggcgttcggtgtttcggtcggcgaagattatggcgtttatggtgaagattatggtgggcggttagttgaagaattttattgggagtttgggaggcggcgagga

SEQ ID NO: 10298 - DNA, 201 bp, Artificial Sequence
  Description of Artificial Sequence: Synthetic polynucleotide
gcgcgggacggagttttatgaaagttggaagaagtgattataaatcgggattcgattttcgtagttttggcgttcgtttttttacgtaggttcgggatgtcggttttagtttttagatgtcgggaagacggcgtcggttagtttaaggaagagtttttaggaggttggggagtaagggtgtcgggttttttatgtcgggtt

SEQ ID NO: 10299 - DNA, 201 bp, Artificial Sequence
  Description of Artificial Sequence: Synthetic polynucleotide
ttttgttggttagagtcgggtacgggtcgggcgggcggcggggatcgtgatcgcggttgcgtgcgttcgcgttcgggcgtttttgtgcggggttttggtacgtcggcgggggcgattcgggtgtcggttcgtgcgggcgatacgcgcgtttttgcggggttgcgcggggttcggagcggttgggggttttttgtcgggcgc

SEQ ID NO: 10300 - DNA, 201 bp, Artificial Sequence
  Description of Artificial Sequence: Synthetic polynucleotide
tagatttcgtcggtcggcgcgttattcgcgttagtattatggatagcggtcgttttagtcgcgcgtttagggttaggttcgggttggtttttatcgcggacggttgcggggtcggggtagtttcgtaattttaaatttcggtagttttcgtttagtagggaggggtttcgggggcgaagagtgggggagaagtcgggaagg

SEQ ID NO: 10301 - DNA, 201 bp, Artificial Sequence
  Description of Artificial Sequence: Synthetic polynucleotide
gtgtgagtttcgggggttcgggtcggcggttttgttagtcgggtcgtgcggttgcgggggtggggcggcggcgtcgttgttatattagtttcgggagcggcgagagggaggttggggtgggggcgcgaggggggcggcgcgaggggggtcgattttgcgggtaggtgatattatatttcgaaggttttagtgcgcgggcgg

SEQ ID NO: 10302 - DNA, 201 bp, Artificial Sequence
  Description of Artificial Sequence: Synthetic polynucleotide
gtcgcgttatggtgagtcgggcggggtaggtcgcgcgttcgggtcgggcgggggcgtcggggttcgggggcgggaagggggaggttaggacgaggaggggcgcgcgcggcggcggggtcgggtcggggtttgcgggcgggggaggggcggttcggcgggcgcggttcgggggagggttcgttttaggggtcgcgttcgcgg

SEQ ID NO: 10303 - DNA, 201 bp, Artificial Sequence
  Description of Artificial Sequence: Synthetic polynucleotide
taatcgggtattttcgcgcgtatacgttcgtgtttacgtgtgtacgtttatatttttgtatatatttaggcgcgcgttggtatatttattcggagaatttcgtatatatacgtattcgtaaatacgcgggttttttgcgttattaggaagtagtcgttagaatcgtcgggtgttttttaattatttttgggagatttggtt

SEQ ID NO: 10304 - DNA, 201 bp, Artificial Sequence
  Description of Artificial Sequence: Synthetic polynucleotide
atacgatatggttaagcgtcgtcgttcgaatcggtcgtcgtcgatatttcgtttcggttcggggttgaggaggaagtcgagaaggaggaggaggaggcggcggcggagggcgggggaagaggacggtcgtttcgggtttcgtttgagttcgtagggtaggacgagggagcggcgcggtgagagaggcggatgaaggcgagg

SEQ ID NO: 10305 - DNA, 201 bp, Artificial Sequence
  Description of Artificial Sequence: Synthetic polynucleotide
cgcgtatagcggcggcgagtgggtcgtgtacgcggatgcggggtgggagtgggggcgtacgcgcgggcgtgggcgagcgggtttcggtagtgtatatatacggtaggggcgggcgatagatgtagtgcgtgcgtcggagtttaagcgtataaacggaaagagcgggcgcggtgcgtaggggcgggcgtttagcgggtttgg

SEQ ID NO: 10306 - DNA, 201 bp, Artificial Sequence
  Description of Artificial Sequence: Synthetic polynucleotide
ttttaggggagttaagtagttcgtttgaagttttttatttggaaatgacgtgtttaattcggcgtttttgtagtttcggtcgtttttttttgtttaatttcgcgtttttttagtttcggtcgtttttttcgtcgtttttttttcgcggtcgtttatttttgagatttttggttttattgagacgtttagttttattcggta

SEQ ID NO: 10307 - DNA, 219 bp, Artificial Sequence
  Description of Artificial Sequence: Synthetic polynucleotide
ygtttgtttygtygttygtatyggtttagttttyggygttygttygtttttttygttyggagygttgtgagttaggagtagtygtaggtttttyggaygygttygtygygygtattaygtggttyggaggyggtygttagtttgygttygygatygggggyggaygttgtattatyggttyggagttgggtaggggaggtttttygttttttttttagg

SEQ ID NO: 10308 - DNA, 315 bp, Artificial Sequence
  Description of Artificial Sequence: Synthetic polynucleotide
gaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyg

SEQ ID NO: 10309 - DNA, 201 bp, Artificial Sequence
  Description of Artificial Sequence: Synthetic polynucleotide
ygygtygttttagygttttgtagyggaggygtygtttttatttygatygtaggttygttygggtygttygttygtygggtatygagtygttttgtygygygttgygtttyggggyggggtgggaggagagggagtagtygttattttgtttaggtygtygygggttagttttgtagttagttttagttttgggtygggtgt

SEQ ID NO: 10310 - DNA, 201 bp, Artificial Sequence
  Description of Artificial Sequence: Synthetic polynucleotide
gttyggagyggtygtgaggggyggayggggggtttyggggygggtttgtaggttttggggatttgaggttgtygggaggggttgttagggggygttggtygggygtygggttttgyggagttggggygtygatttttgattygygagaggggygttttygtygtgttggtygtagttgttatttttagygtttttattatt

SEQ ID NO: 10311 - DNA, 201 bp, Artificial Sequence
  Description of Artificial Sequence: Synthetic polynucleotide
yggyggtgattgyggtttygygygyggttyggtttaggtaggattygaagygyggtttygggyggyggyggyggyggyggyggygtggtttygttygggygggttttgygggataagayggggagtyggttayggggtggggygattggygtttygggagtaggaggagaatygygggtaggygggyggggagggtgygyg

SEQ ID NO: 10312 - DNA, 201 bp, Artificial Sequence
  Description of Artificial Sequence: Synthetic polynucleotide
aagtttttygtttagttttgtyggttyggtttgggygttgtggatyggtaatagtagttttattaggatgtaggtyggattaagtttttggggaaaattygttgtaataattgttttttatatataatttttaattttttttttattttygtttttaattyggagatttgtaaagtttaagaaagggaaaagtaattttat

SEQ ID NO: 10313 - DNA, 201 bp, Artificial Sequence
  Description of Artificial Sequence: Synthetic polynucleotide
tagtatygtttyggtttygygttaggyggygggggaggggaggagggatttttttaggggtgggtttggagggggtgggggyggttttttttttygtttygtygygggtttattgttygggaggggyggggagatagtggggggtagtttygggygggagtggaggyggagatgtygtygtygtagtygtygyggtggttg

SEQ ID NO: 10314 - DNA, 201 bp, Artificial Sequence
  Description of Artificial Sequence: Synthetic polynucleotide
ttttatgaygtygaattgtttgggggatygttagyggtgygtyggtyggagttagttggtggyggggygggyggttyggagtgtttgtttaattttgagygttygygagggggaggggaggtagttggttaygggttagggggtagtaaggtggaggagygggggttgggaaaggggagggtatttttygggttgtttgtt

SEQ ID NO: 10315 - DNA, 201 bp, Artificial Sequence
  Description of Artificial Sequence: Synthetic polynucleotide
ttttttygttttagttagayggggygttygygttttttttttygtttygygttggtttttaataggaagtygtttyggtttttagtaygtgatttttatygtatttgtatatyggagggygaattggttaatyggtattttgtatttgagtttttttttygygygtttttttyggtttattggtttttyggttaggttayg

SEQ ID NO: 10316 - DNA, 201 bp, Artificial Sequence
  Description of Artificial Sequence: Synthetic polynucleotide
gtygttatygttatygtagttgtagygtttttttatatttttagygygtygtyggtygggtagtttggtygyggtayggaggaggggttttggagggggyggtygggggaggygaygtygagttatygttttygggtagtygtygtygggggggagygyggagatttgaaagggygygtygggtaaygttttttttttttt

SEQ ID NO: 10317 - DNA, 201 bp, Artificial Sequence
  Description of Artificial Sequence: Synthetic polynucleotide
ttattgttttttgggyggtgtggattagttgtagagtgtgatttgyggttagggagtgttttttyggagttttygtttttagatttttggtgttaaagaygttttgtgagygggtggggtygggygttttagttayggyggtygtygtttttttttttygtaggaygggatagygtttttgtggatygygttttagatggg

SEQ ID NO: 10318 - DNA, 201 bp, Artificial Sequence
  Description of Artificial Sequence: Synthetic polynucleotide
ygtggaggygataggygtyggygataattttttagttygggygtygygygtygtttygygggaygygtattggggatttyggtygtttttttygtttttygygyggatataaagttyggtagtygyggygtttagagggtygagggttatyggatagttygggtagattttggattygtttygygggagttgtttttttgt

SEQ ID NO: 10319 - DNA, 243 bp, Artificial Sequence
  Description of Artificial Sequence: Synthetic polynucleotide
aaggttggagggtgttagaaagatgatyggtygggtayggagyggggagttyggagtygygygtggggaggggaggtggaggagggggygtygggggagyggggggygygtgaggggtgygagyggggttyggggggygygyggtgggtgtggggggygtygggtttatttatttttygttagygtygttattgtyggttatatgattgaggttgttgttgggatgayggttygggttttagt

SEQ ID NO: 10320 - DNA, 201 bp, Artificial Sequence
  Description of Artificial Sequence: Synthetic polynucleotide
ttttgtatttgtaatttttyggggtagtgatatagttggtttyggtgttttggyggagggtagaagtgatggtyggttgyggttttgtagggtgagaatygggttagataagtgagtgttttagagtyggggagttgtatayggaggggagggagtggygggygttgygtygggtttttttaggaagaggtgagygggttg

SEQ ID NO: 10321 - DNA, 201 bp, Artificial Sequence
  Description of Artificial Sequence: Synthetic polynucleotide
ygaatgtggttaagggggtygtttagatgggtgtagatayggttaagatygtgttgatyggtattaaggatattgtttgtagtggggttatyggtgttgygaaygtggttaagggtgttgtgtaaattgggttgaaaaygatttaaaatatygtaataggtataaagaatatttttggtagtggggtgatyggtgttgyga

SEQ ID NO: 10322 - DNA, 201 bp, Artificial Sequence
  Description of Artificial Sequence: Synthetic polynucleotide
gtygygtttttgggaayggttagggaagtaagtagaagtygggaagtygygaaagaggygagaaagtgygattttttttttagattttyggtttttygtygaaatttttgtyggtyggttaaattttagataatggaagttttaygtttttatttttatttttttttataagttyggtygygggtttttttyggttyggga

SEQ ID NO: 10323 - DNA, 201 bp, Artificial Sequence
  Description of Artificial Sequence: Synthetic polynucleotide
tgtgaygattttttaagggggttttgtgagtattttttttttatagttaggaaattgaggtatagaagggagggattgtttggtaggagttaatagaggygtatagagtagygtgatgagtttygggttttgggggygggttygygagtaggtagtttttattttatggtggatttttaggtttttttttttgtttyggtt

SEQ ID NO: 10324 - DNA, 201 bp, Artificial Sequence
  Description of Artificial Sequence: Synthetic polynucleotide
tayggagtttttttaygygtttattgyggtttygtygtgttaaggggagtttggttgtttaygggttttatttgttagygagaagatagtttggtygggyggttgattttattttgtaattttgatattgtgtttttygggtttgtyggttttatgatttgtgtttaaagtttgatttttygtagattaggtaaaagttaa

SEQ ID NO: 10325 - DNA, 201 bp, Artificial Sequence
  Description of Artificial Sequence: Synthetic polynucleotide
ttttgtgtttttayggygygtagaggyggygtygygaattttgtgtgtattttataygayggyggggattgaggtttttygtagtttagagtyggagttyggggtyggtygagttygtaggatyggttttttygtygatttttayggttttatttagttttttgggtttatggyggygtyggygttggtgagtggagggtt

SEQ ID NO: 10326 - DNA, 201 bp, Artificial Sequence
  Description of Artificial Sequence: Synthetic polynucleotide
ttatygtagtygatagttttataaatattatygttygtttagttttygttttttygggtyggttgttatttygygttttyggtttggttttggtttygtyggttgtattgtayggttygttttttygtttatttgtttattaattttgtagaygttttgtgtttattttttttttttttttggttattttttttttttgtt

SEQ ID NO: 10327 - DNA, 201 bp, Artificial Sequence
  Description of Artificial Sequence: Synthetic polynucleotide
ggygtttttttygttygtttgygggttygttgygttagtygtygtaataaagtttgatagggygtggtttygygggaagygggttyggygttgttyggtyggggygtaggyggttyggttygggttttttyggtagygtygagtttagggttttttaattygttatygtygtygtttgtttygtyggggygttttagtttt

SEQ ID NO: 10328 - DNA, 201 bp, Artificial Sequence
  Description of Artificial Sequence: Synthetic polynucleotide
aaaataaaggatgggtgaataaattgagattyggtttgttgggygttatgtggagatygtgtgtaggaagagttaagatattagagtygggggggtttyggtgatttttgtygttttttgtattttgggtttatggttggggtttgtttttttttagttggtagtgttattttttttgtgttttattaagtttattagtaa

SEQ ID NO: 10329 - DNA, 201 bp, Artificial Sequence
  Description of Artificial Sequence: Synthetic polynucleotide
tgtygtggtttygggttattgtagtttttttgtttygggttttygtggtttttttgtttyggtttgttaagtgtttgggattgygggygggygtygttaygtttgattggtttttgtatttttggaggagayggggtttygttttgttgatygggttggtttttggtttttgatttygagtggtttgttygttttggtttt

SEQ ID NO: 10330 - DNA, 233 bp, Artificial Sequence
  Description of Artificial Sequence: Synthetic polynucleotide
agtattygatttgtgaaaattaygtttatgtagtaatataattggttygaaagygttaaagagttaattaagaggttttyggtttttygtagtttatagygtagttygattttttagagtygtygagtagaygttyggtgaattttagaggyggyggagggtggygaggagttttygttttttttygtttttttttttttygatttygttttttttttttttttttttttttt

SEQ ID NO: 10331 - DNA, 201 bp, Artificial Sequence
  Description of Artificial Sequence: Synthetic polynucleotide
tyggagttgtagtagaagygttttygatttygtttaggtttttagtttatttttttttgaaggtyggtagggggygttattatygttggttttttygygyggtttyggttttygtttygggaatygagtgtttgtagttygygattttggggaggtatagggttagggtatygtttyggyggagaaagtggttgtgtygyg

SEQ ID NO: 10332 - DNA, 201 bp, Artificial Sequence
  Description of Artificial Sequence: Synthetic polynucleotide
gggggaygggttagttagggtaggagtttaaggatatgaggtaaagattttaggttgggatttttygtagttyggaggyggggggtggggagggagggtygggggggtgttgggyggagaygttgggtattggggttagygttgggtagttatgtaygggggyggggtaataggtaggttagttgttgttgttttttagga

SEQ ID NO: 10333 - DNA, 201 bp, Artificial Sequence
  Description of Artificial Sequence: Synthetic polynucleotide
aagttygtgtagygygygtygttttattaaygygtttyggygtaggyggtagaggaaagyggtttttaygygyggygttygyggtttyggggttaggggygyggttagtagtgttagtaygttttttattaygtygtygtygtttttttyggyggtggtygagatyggggygaggttygtagygatyggttyggyggggtt

SEQ ID NO: 10334 - DNA, 201 bp, Artificial Sequence
  Description of Artificial Sequence: Synthetic polynucleotide
taggaatgagtttgttgagggtttagtttyggggtygggagtttgttgtaaaggatatgaaaaatttttattattatttttgtatgtgaaaagaatatgygtgttggaaataattttttaatttatatatttttaaatatttgtttagatttataggagaaatatttttattgatttttgtataaagtgtattggaggaaa

SEQ ID NO: 10335 - DNA, 201 bp, Artificial Sequence
  Description of Artificial Sequence: Synthetic polynucleotide
ggggyggggaggagggyggagggggtgtaaattaagtggtgggaaagagataaaggaagagtgaagagygagayggtgyggatggggaagggggaggggygyggaggggtagtyggtgggtagygygtygaggagttygagtttgaatttgattaagtattgggggttttgtygtgggggtggggygggggtayggtygag

SEQ ID NO: 10336 - DNA, 201 bp, Artificial Sequence
  Description of Artificial Sequence: Synthetic polynucleotide
agtttttaagggaggaggggagagttgtagagaggaggaggggtyggggaggtyggttttataaaggyggttggaataattttgttygttagatttygtygttyggattttttgagttgttygttattttaygtgatygygtygttttttagttttatygttgagtgagttggggygygtttttatttygtttttagtttt

SEQ ID NO: 10337 - DNA, 201 bp, Artificial Sequence
  Description of Artificial Sequence: Synthetic polynucleotide
gaggagtagtagygttygtygggggatgtagtagyggtagyggyggyggyggyggyggtagyggtagyggyggygyggagttttttgygtttagyggttyggtygggttgyggtagaggyggyggyggygtttygtttygggtgaggttgtyggggtygtgygygttggtgagtggggygtggggggtaggtgggtggttg

SEQ ID NO: 10338 - DNA, 201 bp, Artificial Sequence
  Description of Artificial Sequence: Synthetic polynucleotide
gttyggagaagtggatttygttttatygagaggttagggtttttatgttttygttttygatttyggtttagtggtttttgtttttyggattgttttyggyggggyggggttgtatttyggagttttagtttatttygtagtttttttygtatttgatattatyggttattttttataatatggygttyggygttttttaaa

SEQ ID NO: 10339 - DNA, 201 bp, Artificial Sequence
  Description of Artificial Sequence: Synthetic polynucleotide
ggaatttggaggaatatggygttgtygttttttggyggaagygttygggtttgygggtaggggtagttttttagggttyggaggygtagtgaattttygygagttygtagttygagtttygygttttyggygtttttgagttygtttagygttgtttgygtttttttttttttttygttygtygttttttttttttttttt

SEQ ID NO: 10340 - DNA, 201 bp, Artificial Sequence
  Description of Artificial Sequence: Synthetic polynucleotide
gttagggatygttttttattgttttttggttgtygaggagyggttatygggttyggttttagtttttttgttttgatttttttttttaagtttttatgtygagttggagagyggtttttgagtaygtatgtggttygaaaggtggtagttggtygggtttgggttttttatgtgatttagttatgygagggatyggttgaa

SEQ ID NO: 10341 - DNA, 410 bp, Artificial Sequence
  Description of Artificial Sequence: Synthetic polynucleotide
agatatgttgggttagtagtgttggttttattttagattttttttagttttttttagttagtygttaaggggtttttttaatyggaaatttttaattygygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatygyggtgatttygttgyggatyggttygyggtgattttagygygaaygagttggttgtyggttggggygagaaaggtttgyggatyggtttgggygtatgyg

SEQ ID NO: 10342 - DNA, 201 bp, Artificial Sequence
  Description of Artificial Sequence: Synthetic polynucleotide
gagttagagatgtatttttggtyggtttgagtatttgygggaattttgtgagtttttgaggtttattttttgttttttattttttttttttgtaaatttygagttyggggtaaagttgttttttttttttatatttttttttaattygataattaaygttttttagttttygggaatgggayggattttttttaaggattt

SEQ ID NO: 10343 - DNA, 201 bp, Artificial Sequence
  Description of Artificial Sequence: Synthetic polynucleotide
gggatttttygtttttyggtttagggggtatttatttygtaygtggagttygggtagygtttttagaygtatttagygggatatyggagaggaygtygaygtagtgtaaygtttyggtygaagygtygaataatatgygygygtygyggaggaggtgyggggygtgttygtttaggtagygggtygtttygaygtggtaga

SEQ ID NO: 10344 - DNA, 201 bp, Artificial Sequence
  Description of Artificial Sequence: Synthetic polynucleotide
atgtgttttgtygagttgatttgtttagtttattttttattttgaaaygaygttaagtatgaagaagagttgtataaataatgttaataatttyggtgtygtttttatgggggttatggtggttttagtgtattttatatgttttttttttttttgtttttttttttygtgtatatatatattgttttttgatttaagagt

SEQ ID NO: 10345 - DNA, 201 bp, Artificial Sequence
  Description of Artificial Sequence: Synthetic polynucleotide
gtgattttgygaggttatatttygggtgygtygttgygggttygtgggttygtgggttgtagtttttygtttttgtygggtggaygagtttygggttygygtggagttgttyggttaaggtyggttygggaggggygyggygtagggygggtaggggyggggttttaggttaaygtttagttttagatttagtttygtygt

SEQ ID NO: 10346 - DNA, 201 bp, Artificial Sequence
  Description of Artificial Sequence: Synthetic polynucleotide
ggagggagaaagggagagagttttagtygtttyggttgtggtaggaggagttttaagagygtttttygagttygtttygtatttttaggtttagttyggygtaggttttttttttygttttttttattttygttagttgttgaaatttttttatygttttttygygggtaatagtgttygttaggygtygtygygyggtgt

SEQ ID NO: 10347 - DNA, 201 bp, Artificial Sequence
  Description of Artificial Sequence: Synthetic polynucleotide
gtttttaatgygggyggttttygtattttaygyggttyggggtttttgtttatttttygygggygggtttyggatttttggggttttttagttttttttygtttttttttygygtyggtttygtgttttgyggttyggyggtttyggyggygygagtygggggaggyggygaggggtgttttygaggttyggyggygyggt

SEQ ID NO: 10348 - DNA, 201 bp, Artificial Sequence
  Description of Artificial Sequence: Synthetic polynucleotide
ttygtattttttttgatttttatggatatttagttaatagtaggaataaaaattaagatttttttttttttattygtttggatatttattttttyggttygygtygtygtgttttttattyggttatatagygattttaaaagtttagtttttatttygyggagatttygatagttttgggaggttttttttaaaagggaa

SEQ ID NO: 10349 - DNA, 201 bp, Artificial Sequence
  Description of Artificial Sequence: Synthetic polynucleotide
agtygttyggttgaygtgataagggaggtgtaggttaatayggygatttygygttttttggyggtagtgtyggagtagyggygttgtttttgatttattyggtattyggttttygggatygtttggyggttgtgaatgtagagttggggygaygtggggttygttttttgggattgggtgtgagtttgygtagtgagttat

SEQ ID NO: 10350 - DNA, 201 bp, Artificial Sequence
  Description of Artificial Sequence: Synthetic polynucleotide
aattgaaygtttgaaaygaaggtggygyggtttggataaatttgatttttygatatttttygtttttgygttygttttygttaagyggggaggagygatygttataatggattttttygtaggttttgtgygygttgggaatttagttgtygtygtttygtagagttttttgttttyggagggygtttattttygggtygt

SEQ ID NO: 10351 - DNA, 201 bp, Artificial Sequence
  Description of Artificial Sequence: Synthetic polynucleotide
gtttygggygtttgttgtttygtgtttttatygaygattttatttagttgygttaygygtygtttyggttgtyggtygygygttttgttygtyggttttygttygtaatyggyggtttagggyggattygggtttttgygttttygygagaagygyggygttgyggggtygtgggygtttgagttygygyggttttygagg

SEQ ID NO: 10352 - DNA, 294 bp, Artificial Sequence
  Description of Artificial Sequence: Synthetic polynucleotide
ttygtygtttatgtttttattgtaaggtygtagttttygtygtygatttygatttttygtttygtttagtygyggtttygttyggygtttttttttyggtggaagtttaagtttaattaattgagttygaggygggagggaagggttttgygygtygtggttygtttygtttttttttygygttttttttttygttttgggtggtatttttttygtyggtatttataataagtygttgattaatgaggtyggggtygttttatttygttyggtygggtyggggttttygyggga

SEQ ID NO: 10353 - DNA, 201 bp, Artificial Sequence
  Description of Artificial Sequence: Synthetic polynucleotide
taagtttatagaagagtaaatttttatttttygaggttgttgtggaagttatyggggttgggatagtagagaggaatttagaygggaatatygttttttygttagattttyggyggtttttttttttttttttaaatttatttttaaagttaagtgtaggttttttygttttagttagaagygttgygtgagtttttatac

SEQ ID NO: 10354 - DNA, 201 bp, Artificial Sequence
  Description of Artificial Sequence: Synthetic polynucleotide
gaggtttaygttttttagatygttatagtygttgttatagggtttgagtttgggyggygtttygtttyggtygtayggtgygtyggygttaatttttttygaaggtttyggtagttaagattgtaggtttttattaagtattgttttygaattgggttaygagagygtgtttttgattggtttgttttggaggttgggaag

SEQ ID NO: 10355 - DNA, 201 bp, Artificial Sequence
  Description of Artificial Sequence: Synthetic polynucleotide
tttttygygygtygttttttttygtygtyggtygygtgygttttygttttttttttygyggygggagtattttygttygttatttggggattygygtygygtttttygttttygttygttyggygtttatttttygygttttttgttygttggggttataattgttttttatttttyggaggggttattttgggggtggtt

SEQ ID NO: 10356 - DNA, 201 bp, Artificial Sequence
  Description of Artificial Sequence: Synthetic polynucleotide
gyggtttyggtgagyggggygaggggygggtgggtagyggygtygggggaggtygaggaggygaatggtggtgtyggggyggygggtatygggygaggtygyggttagttttttygggtyggagttgggtatygyggggayggggagtgtygggggtaggtgaggttagggtaggagtttaygyggtgggtgygaaggttt

SEQ ID NO: 10357 - DNA, 201 bp, Artificial Sequence
  Description of Artificial Sequence: Synthetic polynucleotide
ggaggygttgygttaggyggaggaggagygtaaggttaagtaygttaagatggaggyggagygygaggtygtgygttagggtattygagataaggtgygygtygggtyggtttygtttgygggaaggyggttttgagtttagyggggatttagatttygtttgggtggaaggggttgttyggaagaggggygggygttttt

SEQ ID NO: 10358 - DNA, 201 bp, Artificial Sequence
  Description of Artificial Sequence: Synthetic polynucleotide
aaagagaaaagaaatagataaaattagggtagggggtaaaaaagtttttygygtttttyggaatttagyggtygyggtygyggttatygtygtygtygtygggggtgggtttyggaagagtttgtttagtagggaaggggaggaygggttaggagygaaattttgtaggygaggaagggatagaygygtaaagaaaaagtg

SEQ ID NO: 10359 - DNA, 201 bp, Artificial Sequence
  Description of Artificial Sequence: Synthetic polynucleotide
ygygggygtagyggyggtygggtaygaggtygggttgatattattatttgttggggygygggaagaayggtagttgttttgygttgtttyggygagggaygtttggaaaaggttgaagttttgggygtttttaagttygttatttayggggttttygttattttagtttgttygtygtyggtygttttttgtgattttttg

SEQ ID NO: 10360 - DNA, 201 bp, Artificial Sequence
  Description of Artificial Sequence: Synthetic polynucleotide
ttttttagggatggttttgtgtttgggttttttttttttttaaatttyggggtggtttttgttttattagattgaatyggttttaaggagaaaagttgaygattattttgttttagttttygggaagttttgttttataaagaataagagtttttggttttgtgaaatgagttataggttgttttgattatgtttatttgg

SEQ ID NO: 10361 - DNA, 201 bp, Artificial Sequence
  Description of Artificial Sequence: Synthetic polynucleotide
ttttaaatttygatygtyggtttggygygyggttgygtttatyggtttygygttgttgtygtygttatygttatttygtygtygtttyggttygygggtygtttaggttagtattygggtyggtttgttttygtyggtygttygggtgttygtygtygygtygygtttyggtygggygtggatggagggygtygygygttt

SEQ ID NO: 10362 - DNA, 201 bp, Artificial Sequence
  Description of Artificial Sequence: Synthetic polynucleotide
yggtyggatttttttttagattgtttgyggtttgaaggggttaggttygygtaaggttttaggttgtttgggygtygggtygtattgttaggagttgttygggagtggttttttaggaatattaggtattgattatatattaggggttgggaaattaggtggtttgtattaaggyggtttyggggatttgtttgtggtaag

SEQ ID NO: 10363 - DNA, 463 bp, Artificial Sequence
  Description of Artificial Sequence: Synthetic polynucleotide
agygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygt

SEQ ID NO: 10364 - DNA, 201 bp, Artificial Sequence
  Description of Artificial Sequence: Synthetic polynucleotide
ggggaygttagtggattggagtygyggagtttygagggaaaaattttgtaggygtygyggtygggattyggttayggttttagtttattttagtaggtgygggaggaagaggtagygtyggagtttygaggttagagagtttyggyggyggyggtygtttttttttttygagttggtttgaagtygttgggtattttyggt

SEQ ID NO: 10365 - DNA, 201 bp, Artificial Sequence
  Description of Artificial Sequence: Synthetic polynucleotide
agggttgggaggatttgtagtttttttgttggttttttttttttaggaagtyggttagtttggagtyggttgtttatttygatttatttttygtttgggyggagtaggaatgtggaagttggttygaaaggattgtgtttttttttygttaaatatttttttttygygttttttattaagttttggtyggggttgtggagc

SEQ ID NO: 10366 - DNA, 201 bp, Artificial Sequence
  Description of Artificial Sequence: Synthetic polynucleotide
agggyggagttttyggggtagaggygtttygyggtaagatygtygaagtgggtttygayggttgggtygttgttttyggggggtygaagggtgygggttygggtttygggggtyggggttttttttttagtattaygaatttgaygtygtygagtttttttattatygttaygttgttgaygaattgtttgaagyggtttt

SEQ ID NO: 10367 - DNA, 201 bp, Artificial Sequence
  Description of Artificial Sequence: Synthetic polynucleotide
yggaggaggttgyggggggtttyggtttaggygaaggaagggtaagaggttgttygatygggggyggygtygggaggtgggtgggtttaatatttaggtygggggaggggtttaagagatatygggaagggtagtygagttttaggggygggtggggtggtagttgtgtgtagtaggggatagggttgggtttttggaagt

SEQ ID NO: 10368 - DNA, 201 bp, Artificial Sequence
  Description of Artificial Sequence: Synthetic polynucleotide
tagtygatatgaygygyggygtagttaatgggaggyggagttggygttttttggtygggggggggtyggaggggtgggtttygygttttyggtgtttgtygtgtttattgaatggagagagygagygtyggttagtttattyggtygtttygtgttttagtygtagtygtygygttttttagtttagttttaagtyggatt

SEQ ID NO: 10369 - DNA, 201 bp, Artificial Sequence
  Description of Artificial Sequence: Synthetic polynucleotide
ttttttttaagtttttttttggggattgatattttattagtatagagattaataatgttagataagagatttttgattttatatttggggttttyggaaygatgtttgggagagaaaatatgaygttttttgtagaggygaattttagttygggaggagggaggtygttgggatgtgtygtyggyggtttttgggttyggt

SEQ ID NO: 10370 - DNA, 201 bp, Artificial Sequence
  Description of Artificial Sequence: Synthetic polynucleotide
agattggattygaattyggtttattttattygagyggygaygttagygttgattttaggygtgtttyggttttyggygyggtttyggtttaatygtgtaygttygyggaaggtttygtattygygttagaagtggtttgttyggggttatyggttygtaagttttyggtgttttygaggtttttgtttygtttygygyggt

SEQ ID NO: 10371 - DNA, 201 bp, Artificial Sequence
  Description of Artificial Sequence: Synthetic polynucleotide
ggggttggggagggttgtyggyggygyggyggggtyggygggaggygggaggttgygygyggygygggagygtgygtyggggttagtaggggyggggttygygyggtygtygggattggaggygygggggtagygggtagggtattttgagggtatattttyggttatttggygggagatttagttttgtygygygtygtt

SEQ ID NO: 10372 - DNA, 201 bp, Artificial Sequence
  Description of Artificial Sequence: Synthetic polynucleotide
gtttyggtygtygggygygtagtygtttttttygygttttgttygtttttatggtattttttaggaaygggaagggggtgggagtygagtyggyggtygygtygygtygaatgtgtgttttttttttyggttgtttayggyggtygaggygtattgtattttgttggygtygaagggtgttttggaatagtagagggagga

SEQ ID NO: 10373 - DNA, 201 bp, Artificial Sequence
  Description of Artificial Sequence: Synthetic polynucleotide
tttagtgttgttygggygttttttygtagtagttttagggygaggaggatggggggggttttygtaggggttatattgtyggagttttayggattygggygggayggtgaggtttttatattgagtyggtggtaaagttttygygaggatgaaggaggaatttygtgttttttattttattaggtttygtattttttggtt

SEQ ID NO: 10374 - DNA, 258 bp, Artificial Sequence
  Description of Artificial Sequence: Synthetic polynucleotide
ttttttgggataagaagtggagtggggyggttaggaygygggtygtggggatygygagggaggagggggyggtygttyggatttatttygtggggttttygygygygggygtttyggygtgtyggattatgtygtyggtagtttygggayggggaayggaggygtttaggygtygggtygygyggaaygyggagtttygggygttygtatgtttttggttttggttttttggaagggttaggtygtygttgtygtygc

SEQ ID NO: 10375 - DNA, 201 bp, Artificial Sequence
  Description of Artificial Sequence: Synthetic polynucleotide
ttyggtygttaygtttttttygagggtygtttygttttygtygggtttygygagygygyggtgggggaggggagggtttyggagygygtttgygtggggygggggyggtagtygattaggggttgggtttggtygtttagggtygggttttggttygtygtttayggtgyggagggttggtgggttttttttggtygtygg

SEQ ID NO: 10376 - DNA, 201 bp, Artificial Sequence
  Description of Artificial Sequence: Synthetic polynucleotide
tagtagttttttagagttttggtttggtagggaggggayggygttygagtagttatattgtagtttttygggtttttttttyggtyggygtaggtttygygtttaygattttttttgggagtyggatttgttttttttatygtygttattygtyggtttttgygttttttggttttygatatttygtttggtygttttttt

SEQ ID NO: 10377 - DNA, 201 bp, Artificial Sequence
  Description of Artificial Sequence: Synthetic polynucleotide
ttttygygttatttygggttygttttygttyggttttttyggagyggtygygtttttagtyggggagtttaggggttttggttygyggagtygggygygyggggggyggttggggtygtagtagggggaggttyggygttygtagtygtyggygyggggtttatygggygtgtgggtttatttyggtyggggygygayggg

SEQ ID NO: 10378 - DNA, 201 bp, Artificial Sequence
  Description of Artificial Sequence: Synthetic polynucleotide
gggtttttagtaygygttttagygtyggagtagggttagggtttttttgygattyggtttygttttagatttttttagttttyggtygyggattygggtygygtgtgagygttttttgtattttttatttttagggttygtygagagttaygattttttatagaaaatgagygataaagagattttgtattgttttgattg

SEQ ID NO: 10379 - DNA, 201 bp, Artificial Sequence
  Description of Artificial Sequence: Synthetic polynucleotide
tygggtttagggygtygtttgtagttgygygyggtygtttttagatggaatttttttattaaygtaaggttyggtyggagtagttattygggagttgggyggygaggggttatttttttttatttyggygggtgtaggatyggggggtttgggtagtaattagtggggaggagygttggattgtgtaygtygagttyggta

SEQ ID NO: 10380 - DNA, 201 bp, Artificial Sequence
  Description of Artificial Sequence: Synthetic polynucleotide
ttygttttattttttgtttgttttyggttgttagagatttaggtgtagagagattttagaggtggygttyggggttttggygttttttttgyggaygttygttgtagagtaggaagtygtygtttyggggyggaggggygagtygggttagggggtyggggtggagaggtttgtagggtttgygygttttttttattygyg

SEQ ID NO: 10381 - DNA, 201 bp, Artificial Sequence
  Description of Artificial Sequence: Synthetic polynucleotide
agtattaggttyggtttttygtatatygtttygaatttygggggtaygggygygggtttttygggtttttygggggaygyggggtttttaagttaaaygygyggttygggggayggygtygygggttttttygggtaygygygttttttaggggaygygagttttttyggggaygyggygttygygttgtyggttttttat

SEQ ID NO: 10382 - DNA, 201 bp, Artificial Sequence
  Description of Artificial Sequence: Synthetic polynucleotide
ttttyggtygaggaggggtygygtggygtygyggggggygggtygygtaygtttttygtagggaggatttagggatagttagggtttygggagagttygygygtatygttyggtttygyggygttagttatggygttygtgygtggtttygttagggatggggygaygyggttagagtygtaygygatygaaattygtatt

SEQ ID NO: 10383 - DNA, 201 bp, Artificial Sequence
  Description of Artificial Sequence: Synthetic polynucleotide
gttagaaaggatygagaaaaattttaaagttttaagtttgagttagggagggttttagagggaggtttgattgtagatygggagtttttttttttygtgygtygttgttygggaygagaaattygtggggtatttaggattaggataygaggttttagtttgggtaggtggataagttgtggggttttatttttygtaggc

SEQ ID NO: 10384 - DNA, 201 bp, Artificial Sequence
  Description of Artificial Sequence: Synthetic polynucleotide
gtygttgagtaygygttttaggtaggttttgggaagttygggatggaagtagttttttttttttygtttttttttttttttttttttttttttttttttygygtttttttttttttttttgttttttttggaygtgggttgtyggttgtagttyggagggayggggygygggayggagtttttygygggaggaggggtygg

SEQ ID NO: 10385 - DNA, 203 bp, Artificial Sequence
  Description of Artificial Sequence: Synthetic polynucleotide
gtaggagyggttygtgttygygggygggagygtgyggtttggattgtttygtyggataggtattgttttttygttttttygggttygaggygggtygygygygtyggtygtygttygggygtttygyggtgggygagatgygtygygttygttttatgtttgtygttygygygttttttgttttttatttygtagtygttygt

SEQ ID NO: 10386 - DNA, 201 bp, Artificial Sequence
  Description of Artificial Sequence: Synthetic polynucleotide
tttttygtagagggtaggatatttattttttygtgtatttgtttttttttyggtttttygtttttagtagtattttaggatttaggggtgttatygggtyggggagggaggggttgagtttgggtttggggatatygggatagggggaggggttggygttttygtttggtygggatttygtggtttagygyggttttayga

SEQ ID NO: 10387 - DNA, 201 bp, Artificial Sequence
  Description of Artificial Sequence: Synthetic polynucleotide
agygtttgtttaatttgtagtgatatygtttagttgtttagggttttagttgttatagttaattagttygyggtyggggaggagygtygggtaggggggygggggggtatgaaggggtyggygggggaggttgtgggggttgtaggaggggtaggygtaggaggaggtttgtggtttttaggttyggttygtttttttagg

SEQ ID NO: 10388 - DNA, 201 bp, Artificial Sequence
  Description of Artificial Sequence: Synthetic polynucleotide
gggygtattgggygaaggygaygygyggttygtgggtgtagygttgggygttttgaggaggtttttgttgyggtttygggygtttgtgyggtttttgagygyggagttgggatygygttttttttygttattggaygaygtgagtaaaygtttygttttygggtttygtttttgtygttgttatygttttygtttttttag

SEQ ID NO: 10389 - DNA, 201 bp, Artificial Sequence
  Description of Artificial Sequence: Synthetic polynucleotide
taggtagaggggggygggagggggtgtgagggagaggaggagtyggagtygtygttgyggtttttttyggggaggggagaggagaatttttttttttttygtttttttttagtttttygttggttygggagggggtggggygtygaggtygyggygattyggtagggtttggtyggtgaagagtaggygggyggggtgygg

SEQ ID NO: 10390 - DNA, 201 bp, Artificial Sequence
  Description of Artificial Sequence: Synthetic polynucleotide
ttaattttgygttttttttttagttygagttttttygttgtttttttttttttttttttygagtttttttttttttggygyggygtygttagttagtttyggyggggagagtgtaggtattttgtttttagaataattagtaggatttaagtyggtttttygagygygttttttttttttttttttgtttttttttttygg

SEQ ID NO: 10391 - DNA, 201 bp, Artificial Sequence
  Description of Artificial Sequence: Synthetic polynucleotide
ygyggayggygttygatagtagttggaggagyggtttgtygatttggyggygagttatttggaggttattygtgygygggaygagtgggatyggtagaaygygyggttgygttaggagaaygttyggttgyggttygagaatyggyggttgaagygygagaatygtagtttttttygttaggttttgyggtttttyggyga

SEQ ID NO: 10392 - DNA, 201 bp, Artificial Sequence
  Description of Artificial Sequence: Synthetic polynucleotide
ttygttttttygttttagttygygtatttatygygtaygtagagtagtgatatggtygaggatygggtaagtttttgtygygttttagtygygtyggatygttttttttttttttttagtaggtgtygygattgttttygttatyggttttaygggtttggtagttttttatggtttyggtygtaggtagygtttygtygt

SEQ ID NO: 10393 - DNA, 201 bp, Artificial Sequence
  Description of Artificial Sequence: Synthetic polynucleotide
tggttattgttgygtaggygtagttttgggagyggygggagttggaagtttaggagttttagggggygtagggtygggtagaaggyggygagttgggggyggatatttatyggggattggaagyggttygygtaggttggggatattyggggttagggygggtygtttggggtgggagagtatagtgaggaagtttgaygt

SEQ ID NO: 10394 - DNA, 201 bp, Artificial Sequence
  Description of Artificial Sequence: Synthetic polynucleotide
ttggggaygtygtagttyggttyggggagggggygttaggtygggagtygtagygygggagggaygagttygggtyggyggggggaggggagygggaagygtttttgttgttggygatygggattttttttyggtataggggaaaggyggggaagttattttttatygggtttgtgtttttgagaggattttttgatggtt

SEQ ID NO: 10395 - DNA, 201 bp, Artificial Sequence
  Description of Artificial Sequence: Synthetic polynucleotide
ggtttttgggaggygtygygtgggggygyggttygtggagttygggygttagggatyggtyggggtyggygtaygggtgygttttgggttygttygggtygtgggagttagggagttagggagttagggatttyggttttygtayggggtagataggggtagygygggygattyggagygtttgygttttygyggtttttt

SEQ ID NO: 10396 - DNA, 523 bp, Artificial Sequence
  Description of Artificial Sequence: Synthetic polynucleotide
agagtatygggttttttattgttttagagygygtgtgyggttttgggygygtatagtgayggtgayggtatttttggttyggtagygtygaggtygtttygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtygtggtttttygggggyggtatygttaggtgagygtyggtyggggygaggtygggtttygggyggtaggtayggggttaggtggttttgaaatttggygtag

SEQ ID NO: 10397 - DNA, 201 bp, Artificial Sequence
  Description of Artificial Sequence: Synthetic polynucleotide
yggyggtaggygggggagggggtgggggtgtaggggyggtttygygggtygyggggggggygygyggygtagyggggtttygggyggggygtagygggtygyggggtttygggygygtttttygygttattttagtgttatggtgygttygttgagtygtygggtttagagttggggttggyggyggagggataygggtyg

SEQ ID NO: 10398 - DNA, 201 bp, Artificial Sequence
  Description of Artificial Sequence: Synthetic polynucleotide
ygttttttygttttttyggtatttgtttattttygtaattgtttyggtttttaatatttgtatygtttaatttttttttttttygttttttgtttttttygtatttgttyggagttttagtatttgtttygtttttygttatttttttttttgttggtttgatggggtgtgggtttaagggagttatatttgggyggaggt

SEQ ID NO: 10399 - DNA, 201 bp, Artificial Sequence
  Description of Artificial Sequence: Synthetic polynucleotide
tttyggtttgayggaatataggygaygtaygtgaagtttaggttttattttagygtaggygggtttttagygatttatagttgttatatattyggttagygtygattttygaaggygtattttttatattttatttygagtatyggttttatygttagggaaggtttttttggatagtaaggtyggggtttaggatttgyg

SEQ ID NO: 10400 - DNA, 201 bp, Artificial Sequence
  Description of Artificial Sequence: Synthetic polynucleotide
yggtaattttttttatygttttttgtagtaggygtygagtygtygttattttgtttttygttttttttttttttttatygatatttatatagygaaaatyggttyggtyggtttgyggtttttattttaygtttgtagttttygttttttygttaggttttatttyggygyggtgttttaggtyggtygyggagtygattc

SEQ ID NO: 10401 - DNA, 201 bp, Artificial Sequence
  Description of Artificial Sequence: Synthetic polynucleotide
ygtyggygggygggaggtatataygygygtataagyggaaagaaagygggtttattgygtggggatgttygttygygtagttgtttyggyggyggyggtygttgtttgtatygaggtygaggygyggyggtggyggyggyggttgyggattgagtttttttygtygggyggtggatgtagggygygggaggggygygaggg

SEQ ID NO: 10402 - DNA, 201 bp, Artificial Sequence
  Description of Artificial Sequence: Synthetic polynucleotide
tttttygttagygtttttygttygttygttttttttyggtttygtttygyggggttgttggagaaattaagtttggggttttttttgtygagtayggggygagttttagaaggttttgtygtgatggaaaatttttaggtaaattttttygggttygtggtttttaggtygggaagttttygttaygtgaagggttttygt

SEQ ID NO: 10403 - DNA, 201 bp, Artificial Sequence
  Description of Artificial Sequence: Synthetic polynucleotide
tttttatatagaaaatttgtattagttatgtaagttaaaaagttgtgtgaatttaggtgtttyggaaaggggttgtaggatatagtaaaatgttagtagygtgtyggattttttttttttatttttttttttaaagaatagaggttaggaaaaatattggttgggaygttagaagggttatgtgttaattataattatatt

SEQ ID NO: 10404 - DNA, 301 bp, Artificial Sequence
  Description of Artificial Sequence: Synthetic polynucleotide
gyggatggggttttgattagttgtggatttttgttttagygtatttatttaatygtgttttttttggttggtagagggygttaaaggygaygtgtyggtygttagttttaggtygagtttygagygtttgtaggaataygtttttttattyggygygggaygtagagttgygagagaattttgtttagygyggatttaaygttagggygtygtttagaggttggtttttgtttyggttttattygtygggagattatagagttgtttttttagtygttygtygttagaaattggaaaaaaa

SEQ ID NO: 10405 - DNA, 223 bp, Artificial Sequence
  Description of Artificial Sequence: Synthetic polynucleotide
ttagagttgtaygtagatgaataygaagagtagygygtagaatayggtgtagaygayggtgaggttaagttttaygtaggggggtayggtyggggttagygtgggyggtagygagtygttgygggttgggttttayggyggggtttttatygggtygggggygttgtygygyggtyggggaygttygggttttatyggggtttayggtygtygtygttttygc

SEQ ID NO: 10406 - DNA, 720 bp, Artificial Sequence
  Description of Artificial Sequence: Synthetic polynucleotide
tagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgtt

SEQ ID NO: 10407 - DNA, 1683 bp, Artificial Sequence
  Description of Artificial Sequence: Synthetic polynucleotide
atygagggagggtgtaaaaggyggggggyggagggggggtagattagattaggygaaatttaataagtttttagttttttagtttaaagtttttattatygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyggtttagtggtttttgygygtyggagttygtygygaagattgagyggtygyggggatygtygygggtttygygygtatttttgggtttaatattgttatta

SEQ ID NO: 10408 - DNA, 233 bp, Artificial Sequence
  Description of Artificial Sequence: Synthetic polynucleotide
aaataaaaagattaaaggagtagyggtyggggyggtagyggtttttaggtygggatattyggggtggtgygttygggtttgygggggttgygtyggygtyggggaggyggggggagygggagygggygaygyggggaaggggggagttagggggagggygtyggtyggaggaggggyggattygttygttttagtygagtagagtatagtygagtygagyggttygggygggg

SEQ ID NO: 10409 - DNA, 213 bp, Artificial Sequence
  Description of Artificial Sequence: Synthetic polynucleotide
tttttttttaaagtaaatagtatttttttattattttgtagttgggttttttttattggttttygttttttyggtggagayggygaygtggtttataygygagtttttygtygaggatgaattattagttagttygagttgttatattttattttagtatagttatygygagagtttyggggtygygtyggygtgttttaygtaygygtagtt

SEQ ID NO: 10410 - DNA, 236 bp, Artificial Sequence
  Description of Artificial Sequence: Synthetic polynucleotide
ygygttgagttttattttgyggyggtyggaygtttyggygtagggggyggygyggygggygyggtgttgggtatygataaygtgtgygagttggyggygyggttgttttttagtatygtggagtgggygygttaygygtttttttttttygagttgtyggtggtygattaggtggygttgttgygtttgagttggagygagtttttygtgttgaaygyggygtaggyggygttgtt

SEQ ID NO: 10411 - DNA, 233 bp, Artificial Sequence
  Description of Artificial Sequence: Synthetic polynucleotide
ttagttgtggatttttaatatttgtaggttataggattagaggttgggtttttaggagtagaggatatagagtagtgaagaygagattyggagttttagyggtagttaaagataaagaagyggataaatttygttatatttyggaagtygtttttttygtttaagttgygtgtttgattggatagtttttagtttagygtygttgattggataaygtttaaaattttattttt

SEQ ID NO: 10412 - DNA, 737 bp, Artificial Sequence
  Description of Artificial Sequence: Synthetic polynucleotide
ttygttygatttaggtttygagtttttttttygattttttttagtttaaaggttgtattygttttaggtttttttagttyggttttttagtttttttttyggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygygttgtygggygaggtyggtttaygtggagtygggagtttgaggtttttgtaygygggagttgyggaygatggtggttagtgttattgtttaygaygttatt

SEQ ID NO: 10413 - DNA, 308 bp, Artificial Sequence
  Description of Artificial Sequence: Synthetic polynucleotide
atagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtgga

SEQ ID NO: 10414 - DNA, 1100 bp, Artificial Sequence
  Description of Artificial Sequence: Synthetic polynucleotide
tgatgygtttggtgattttttttgggtttttgtttaagyggagttataggttgtgggggyggttaggtttttggggaagagtaggtgtygyggtgtyggygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygygtttygygatttgttyggttgttygygttgtyggyggttgttgtataagtyggtgaygttgttttgygggtttatagtttgtaagygttgygtggagttag

SEQ ID NO: 10415 - DNA, 214 bp, Artificial Sequence
  Description of Artificial Sequence: Synthetic polynucleotide
gaagaaataatatattgtagattgtaaygagtayggggagttagygaaaggtagggygtttattagggygygttgagagatygggaattttygtaagggygttygygtygttygttattygtygtygygygtaygtygygttttygtttatttttaaataatatttatagttagggtttttttttttttttttttttttttttttgttttygtt

SEQ ID NO: 10416 - DNA, 582 bp, Artificial Sequence
  Description of Artificial Sequence: Synthetic polynucleotide
agtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagag

SEQ ID NO: 10417 - DNA, 203 bp, Artificial Sequence
  Description of Artificial Sequence: Synthetic polynucleotide
tttttaggaggygttttgatttygtatttyggttttttatttttygatygttagttttagggtygtygyggygaygygygattttttttttttgaggggygygggtttyggaygygtygggttttgttaggtatttagtggagggtyggaggtyggygattagttygagtttagtygtttygggagttggygygagtgtygtt

SEQ ID NO: 10418 - DNA, 823 bp, Artificial Sequence
  Description of Artificial Sequence: Synthetic polynucleotide
taattatttgttttagatygygttatttgtaatttgtttygggttggygttatattyggygtttyggygttttttataagtgttttygtttatgattagygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygygttggttgygggttttgggggttttttgtttttttygggtttygttttttygtatttttttggtttgattatgatttttgaaggagaatayggataattyg

SEQ ID NO: 10419 - DNA, 293 bp, Artificial Sequence
  Description of Artificial Sequence: Synthetic polynucleotide
ttttgtttttaagggagagggatagtattttttygggtttttagtttttttgggtgtggygggagagttttgggygaggttgygtttatatttgtatttyggtyggttttttyggttgatttygttttggttgatttygygtatattttttttttagygttgtaaggatygtttgaattygttggttatttyggtgatgaattagtggttyggtgtgaagttgygggtgatygagggttgggaygaggayggttattatttagaggagtttttgtattatgagggtygygygg

SEQ ID NO: 10420 - DNA, 262 bp, Artificial Sequence
  Description of Artificial Sequence: Synthetic polynucleotide
gyggggtatgttggygyggttygagggtayggtattggttyggtttttttttygygttyggtttyggyggtttttagtgttttyggtttattgttygggygyggyggttgygggattygygtggygtyggygayggttyggtttagttttgygttttgtaygygygtttttgttttygggttyggtagtygtttttttttaayggggggagggggttattgttttygtttttygttttttttggagttaattagygygttyg

SEQ ID NO: 10421 - DNA, 240 bp, Artificial Sequence
  Description of Artificial Sequence: Synthetic polynucleotide
gttttttttttattgttttttygttattagtygtttttgtygtygagttygtagtygttagygygtttygagtttttttaggttagaggttttygtaggygatggyggataagagggyggggattttagaagtygyggygygttygtygttyggttttgttygggagggggaygygygtayggttttygyggttygggttygagaagttggggggygygggtttttttatttygtagygg

SEQ ID NO: 10422 - DNA, 1240 bp, Artificial Sequence
  Description of Artificial Sequence: Synthetic polynucleotide
ggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygtt

SEQ ID NO: 10423 - DNA, 222 bp, Artificial Sequence
  Description of Artificial Sequence: Synthetic polynucleotide
aataaaaatttatattatatagygatggtggtgtttggtggyggtggyggggtggggggtttgattagatgagtygtttttygygttttyggygtygggygttatggttygagtygaaggygtttttggtttyggagygttygyggtttttgygtttggygyggtygtttaagtaggagaagaaggygtagtttaggaatattyggaagtagtaggtygttt

SEQ ID NO: 10424 - DNA, 714 bp, Artificial Sequence
  Description of Artificial Sequence: Synthetic polynucleotide
tgtgattttttttttttgttttaagtggttggygatatagttttyggygygtygggtattgaggttttggagtatagygtggggggtttggtatagataygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtyggttgttttttggagtatttttgttatagtatttttattttgggttagggtattttgttgyggattttgagttttaggaaggaggtttataatagyggaaagttatttttttttaagaattgttgagtttttyggattgtatttttaaagattttttttgaa

SEQ ID NO: 10425 - DNA, 1216 bp, Artificial Sequence
  Description of Artificial Sequence: Synthetic polynucleotide
tttattttgaggttttttagatttygtagggttttttaygttattaagtttgtttygattttttttygttgttttttatattttttgtygyggygyggtyggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttygggtyggtgtttttgtygygggaaggaggattyggaygtttaatttagyggygaagtygttttttattggaggaggtttttygaaaaygtttttgaaattt

SEQ ID NO: 10426 - DNA, 207 bp, Artificial Sequence
  Description of Artificial Sequence: Synthetic polynucleotide
ggtttgtttagtttttatttyggtatygaagtygtagttttygggtttattttygtatttttaggggttttygggggttgtygataggtttttgattagygagygygttttyggggtaagtatttttggygggtagaaatttgggagyggagtatagyggtgtaagggaatygtgttaggygggaagggyggaatttgyggggaatt

SEQ ID NO: 10427 - DNA, 253 bp, Artificial Sequence
  Description of Artificial Sequence: Synthetic polynucleotide
ggttgygtagygtttttaatttaatttttggatttattttygttttagtttttttygtgtttagygttttttgtaaatgattttttyggtygggtgtttygttttttttttyggtttttttygygtggtttgtttttygttygtttgygttygttyggtttttttgtttttgygtttttatttgatygtaaaggyggttagggtagttttygygyggtttgatagttayggtttttagtttgtttttggaygt

SEQ ID NO: 10428 - DNA, 209 bp, Artificial Sequence
  Description of Artificial Sequence: Synthetic polynucleotide
ggttaggtttgagttttatttatttaygtygtattttttttttttygtgggggtttatatggtygtgtygggygyggtttygygggygyggygatygggygataaygyggyggggayggtygygggttyggttgtggygtatygygagtygaggyggggayggttaggyggygyggggtagtgggyggygtattttttataggtygttc

SEQ ID NO: 10429 - DNA, 225 bp, Artificial Sequence
  Description of Artificial Sequence: Synthetic polynucleotide
ttgygatyggtttttaatttgggtygagttgygtagyggggygggygygyggggyggggygggtygygggttttggggagttggtygggaatyggagttygyggtygtttggtygaatttgttygygyggygtyggggaggagttyggggyggyggygyggggygygygttyggygagggygttttttttagggtygtttgtagtttgygggayggggtygagyg

SEQ ID NO: 10430 - DNA, 1133 bp, Artificial Sequence
  Description of Artificial Sequence: Synthetic polynucleotide
ggaggagaagygaygtaagtgggtagttttttagygtyggygaggygygggaggaggagaagtagtggggaggygtagtygtttatttgyggggtagggygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattygggygtygyggtagttgtttyggttgtyggtyggyggtttygygttygttygtttygttttygttygttgttttgttgtaygaatttttttaatttttttt

SEQ ID NO: 10431 - DNA, 478 bp, Artificial Sequence
  Description of Artificial Sequence: Synthetic polynucleotide
tgaattgagggggttyggyggtygttgaggaggggagygygygggaggaggggygaggagttyggaggygggygyggttggtagtttagagggttygggyggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygygattttggttttttygtaagtttttyggattygggygttttyggtttttttttatttatttttttgtygggtaggttygygatttttygtttttygggtyg

SEQ ID NO: 10432 - DNA, 201 bp, Artificial Sequence
  Description of Artificial Sequence: Synthetic polynucleotide
ttaatgtgttttaataygttttaatgtgttgtgataggaaaagagtyggttaayggtattayggaagtattagttggtatagaggttyggtgtaattatygttttgtatygtaaaaygggtttaggaagtttttaggagatattagyggtgttagaatygagaaagtgaygatatagataatttatggatttygygtaygg

SEQ ID NO: 10433 - DNA, 208 bp, Artificial Sequence
  Description of Artificial Sequence: Synthetic polynucleotide
gttttygtygtygttygggtygygttygtttygtttttaggygtyggtttyggagttyggttygygagtagyggyggttgtyggagggaygatgagttgygyggggygggygggttttgttyggttygtygygttygttttgttgatttgtagtttgtggtyggtaygggtagataaygygagttaggagtattatayggygtttatt

SEQ ID NO: 10434 - DNA, 210 bp, Artificial Sequence
  Description of Artificial Sequence: Synthetic polynucleotide
ttagtttttygggaagtagtaggygtayggtygtttggatttttttggaggtgatggtygagygtttgttgtaatgygttaggygggaagtttygtyggygatgygttygaagatgtygttgataaaggaatttatgatttttatggttttagaggagatgtyggtgtyggggtggatttgttttagtattttgtataygtatayggagt

SEQ ID NO: 10435 - DNA, 229 bp, Artificial Sequence
  Description of Artificial Sequence: Synthetic polynucleotide
ttttaagatagggtttttttttygttygggttggagtgyggtggtaygattttyggtygttgtaaygttygtttttgggtttaagtgatttttttgtttyggttttttgagtagttgagattataagygttagttattatagttyggttaatttttgtattttttagtagagatagggttttattatattggttattttggttttaaatttttgagtttaggtgagtta

SEQ ID NO: 10436 - DNA, 209 bp, Artificial Sequence
  Description of Artificial Sequence: Synthetic polynucleotide
tttttttttttttttaatatttttttttagaaaaagaggaaygtaaygaagggagtttagttattatgttggagttgtggatyggttttgtgaggtttaygygggagygyggaggtttttgggttttagggygtyggtagatggtttgtagygtatygttyggttttygygttggttaygttygttagygttatttttttttttygttt

SEQ ID NO: 10437 - DNA, 255 bp, Artificial Sequence
  Description of Artificial Sequence: Synthetic polynucleotide
gttatttygtagygagttaaagttattttttattttgggttygttaygygatttttgtyggttttygttttaygyggttttagtayggygttaaggtttygtttataaatyggtttygttttttygtgttygggttygtygtttattagaygtygtttyggygtagygagttgagggtaygtttatttttttttygggtttttagtttttaaggttttagtataatgttttaggaggaagattttaggttttttt

SEQ ID NO: 10438 - DNA, 297 bp, Artificial Sequence
  Description of Artificial Sequence: Synthetic polynucleotide
tttattattgttaaygtygtygtygygttttttttattttatttttttttttttaggagaatttttagtttyggtttttttygtttyggygtttygttaygtgatttygggtygttttttataygtgatygtttttttttttttttttattttygtattygttttttttttagttttttgtttygttttgttggtygttaggtatttyggggagaggtygtttggaggyggggttttaggttttatttttyggagggtggagaggggygggtaaattaygtygagtgggyggggttt

SEQ ID NO: 10439 - DNA, 232 bp, Artificial Sequence
  Description of Artificial Sequence: Synthetic polynucleotide
tagtygttttaagtttttttttttttttttttttttttttttgtttyggaaagttagygagttttyggtagyggtygtattttygtttyggtggtttgaygayggyggyggtygtttttgygygttttttygttttttttyggtttagtttagaygtygtagtggyggtaattgyggtagyggtggyggttttgatttygygtatttygttttttttttttagttagtttat

SEQ ID NO: 10440 - DNA, 247 bp, Artificial Sequence
  Description of Artificial Sequence: Synthetic polynucleotide
tttttygyggttttttttttttygygtttttttttttatatygggttttyggggtagtagyggggaggggagatyggygggggagggaggatagggaggygaaggaattggggtggggggtgygtgtgtggtggagggggtgggaygatataggtgttttgaggggaggagtygggaggaaggygaggaggtygggttaagtgggggtgyggaggtyggggagataggaaygyggttgygggygygg

SEQ ID NO: 10441 - DNA, 292 bp, Artificial Sequence
  Description of Artificial Sequence: Synthetic polynucleotide
gggygttgaggttgaagttggggtygggggtgggattgggggygttggggttgggtygggggtgggattgaggttgygggygtttaattgggattgagtygagggtagyggtggggttgggtygggggagtaggggtygygtygggtagygtygygtgttggagyggaggygggtgyggtyggggtaggtygygggaggaggaagygtttggggagtaggagttgggtygggygggttygygtttygtattygygggggtgaatyggagtygtygtagggggttyggggggt

SEQ ID NO: 10442 - DNA, 201 bp, Artificial Sequence
  Description of Artificial Sequence: Synthetic polynucleotide
tgttgtggggtttagggttgtatggggtagtaaggygygggggttygggtygtagagttttyggggaggattyggaggggaggtagtggttyggyggttygggttatagttyggtgtggtgggggggagggagayggggygggagagggggtaaggttgtttttgaagggaattagttggttygttygttggtygagttgt

SEQ ID NO: 10443 - DNA, 201 bp, Artificial Sequence
  Description of Artificial Sequence: Synthetic polynucleotide
atttttgttttttatatttattttttattttygttttagaaataygttttttatatygggttygtyggatttttatattttttattygygttagaaaygygygtattttygtggtttttttttgtygygygtaaataygttyggttygygtaygttttttyggtttggtttygtatattygygttagaaataygygtggtc

SEQ ID NO: 10444 - DNA, 201 bp, Artificial Sequence
  Description of Artificial Sequence: Synthetic polynucleotide
ygaygttygagttagyggagttyggagtygttgggtttttygtttttttygttygttygtttttttygttttttyggtttttttygtttygtygttttgygtygttttattataaaaggtgaggttyggggggagggggygygggattttygtttygyggaagyggtttttatttgttttttaatttgttyggtygygttt

SEQ ID NO: 10445 - DNA, 201 bp, Artificial Sequence
  Description of Artificial Sequence: Synthetic polynucleotide
gttttattaagyggttttagttataayggygtgtatgttaattaygtttgtaggttatygttygttttyggttgtyggattatttagygygttttttttygagtttyggayggggagaggaggagttaggggaggaggygggaggaagggaaggatggggaggataatgggggaagaagagggaggatggaggaagggggt

SEQ ID NO: 10446 - DNA, 201 bp, Artificial Sequence
  Description of Artificial Sequence: Synthetic polynucleotide
tattatttygttgtyggyggygtttttttgggaagtagtagtaattggtggagttggagtygtagtagtttgagtygtygtagtagtttttgtyggagtygtagtaggaggaggaggaggygggygtyggggtgggygtyggggygggatayggagyggggttttgggaygattttttggaaaagtttttggyggaaaygg

SEQ ID NO: 10447 - DNA, 201 bp, Artificial Sequence
  Description of Artificial Sequence: Synthetic polynucleotide
gggyggggtyggaggaaaaggggyggggyggyggggaaaatataaattaaaatttaaaaattagttaaaggaaggatggaagtttygyggttttttyggygtttagyggtgtttttgttttggtgttyggattttagttygyggtttgtttgtttgttagtttygtggatatygtattgtygggtagygtttyggtygtat

SEQ ID NO: 10448 - DNA, 201 bp, Artificial Sequence
  Description of Artificial Sequence: Synthetic polynucleotide
tagtatgatgtygtttttttggtagtggtagggggtygggtaggyggtgggtttygggtygggttggggggygtygtyggtttttygggaagygtatagygyggygtaaagttatagygttyggagtttyggygggttgggtatttyggyggtygggttattggggtatttggyggtygggygyggaygtayggygygatg

SEQ ID NO: 10449 - DNA, 241 bp, Artificial Sequence
  Description of Artificial Sequence: Synthetic polynucleotide
ygaagaaaggggygygggggygygggggygygggggygygtggggygttgggygtyggaggtttggtaggatgygyggtggggtygtygtygtygtygtygttgygygttygttttttggtygggygygygtttygtttygtagtatttatagggygtygyggtttygtttttttataggtttygtttyggttagtttaygtttygttttyggtttygttttttgtygttagggygygtag

SEQ ID NO: 10450 - DNA, 201 bp, Artificial Sequence
  Description of Artificial Sequence: Synthetic polynucleotide
gtygttgtygttttgtygttyggtgtgygagygygttaaggtyggttgygygtygtttatgygttagtayggtttygtttggttygatygtatgygttgygatyggttgttygagtaaggtaattttgataygttgtgtatggattataatygtatygatttaattatygtygygtttagttygtygygtygtttgtygtc

SEQ ID NO: 10451 - DNA, 201 bp, Artificial Sequence
  Description of Artificial Sequence: Synthetic polynucleotide
agaggaagtgagaggtgtttaattyggttatgtagaaygtagttgggttgttygaaaygaaataaagyggttatttygaaggaggtgttgtttttgggtyggtttaggttgagttagagtagaygttatttttaygttaaaaatattaggttattgttttagggagttgggttatttattgaggttatttttattttattt

SEQ ID NO: 10452 - DNA, 201 bp, Artificial Sequence
  Description of Artificial Sequence: Synthetic polynucleotide
gtatttatttttttgayggtttygtttygtagggagggtttgtgtyggttgttggagtttattygtagatttatttttattattttygagggttagaggygygatttygygtattyggygtttygtttgttgygttagtatygttatttggtgattttgttgttttggaggttyggtttygtggtgyggagtaggygyggg

SEQ ID NO: 10453 - DNA, 201 bp, Artificial Sequence
  Description of Artificial Sequence: Synthetic polynucleotide
ggtttttggagttattggtttagggygggttygygggatggggygggyggttyggggygtagtyggttaggtygttgttatggtaaygyggtggaaaaaygggtttttgggtatttygttgtyggtyggttggtaattttttagyggagggatygggtygagttygyggattttttygagtgttttttggggtttagtygt

SEQ ID NO: 10454 - DNA, 201 bp, Artificial Sequence
  Description of Artificial Sequence: Synthetic polynucleotide
ttaaaagtagtttttttgaattttatttgggttttgtagggttttttygaggttygagaattgggagaagggaaagagtttatyggtttgtttgaaggtyggygggyggtgtaggtagttttttttagatttttttagtttyggttttttaygtatattagaagagtygttttttttttttagtgattgaaattatttgga

SEQ ID NO: 10455 - DNA, 201 bp, Artificial Sequence
  Description of Artificial Sequence: Synthetic polynucleotide
ggttttgttttagggttttgtattttygagagttgttgtatgtyggggattggtttttaagtttgtttgagtttttttagtttttygggtatygttatgyggtgggagggtgagttttttttttttgttgaaatttyggyggtttggtaatyggtyggggggttttggatttttyggggagatattattgatgttttgtgg

SEQ ID NO: 10456 - DNA, 201 bp, Artificial Sequence
  Description of Artificial Sequence: Synthetic polynucleotide
gtgtttttygttgatttttagaggagatattggttagggttttttttttygagataaattttattttggaaaggttgttagatygggygyggtgatttaygtttgtaattttagtattttgggaggatgaggtgggyggattgtttgagtttaggagttygaaattattttgggtaatatgttgaaatttygtttttatta

SEQ ID NO: 10457 - DNA, 201 bp, Artificial Sequence
  Description of Artificial Sequence: Synthetic polynucleotide
gtatatttyggtygggtgygggtyggyggggtatagyggtttttayggttygttttygttagttatttttyggttttttttttygttgttygygtgtttygggtyggtttagtatttttygagttaygtgttygygtttttyggyggggaggagygtagtygygggggygygtttyggtgatttygttttttagttttttt

SEQ ID NO: 10458 - DNA, 201 bp, Artificial Sequence
  Description of Artificial Sequence: Synthetic polynucleotide
ttttygygtatygtygtygygtatttatttttaygggtggagyggggyggggtagtayggtttygygygtagtttygattygttaggygtatygatyggyggygtagygttggygygayggttygattyggtygggtttttgtttygggygygggttyggtttgggagygggygagttygtttgtaggggaggyggggatt

SEQ ID NO: 10459 - DNA, 201 bp, Artificial Sequence
  Description of Artificial Sequence: Synthetic polynucleotide
ggggyggagyggggaggggyggggyggagyggggaggggyggggyggagaaggatygtagggttgagyggggygttagygttagtgttyggtattgtttygggttgggttttttgygttagaggaaggggagttyggggayggggtayggggttygygaggtaygggtgttttttyggggtttyggaagttttttttttyg

SEQ ID NO: 10460 - DNA, 239 bp, Artificial Sequence
  Description of Artificial Sequence: Synthetic polynucleotide
gagaggaagggggaaggagatagaggaatygagattggggtgagggagyggtygygygtggttttyggagaggygtttattatttgygtggygttttttygygtyggagtgyggttttgtttttagygttagtgygtygygyggttygtyggtttygtaggattggttatygttttttatttatgtaatttgygtgtgygtgtgygtgtgtgtgtgtgtttttttttygttygtttttt

SEQ ID NO: 10461 - DNA, 201 bp, Artificial Sequence
  Description of Artificial Sequence: Synthetic polynucleotide
ttttttygtgggtggttttygtgagttttttggttagtttttttattttagttttataatggtttatygtttgtaatattttttttgyggttatagtttyggtggatggaggtaggagggggttayggggtgggggagatggatgygaagttggyggggaaagggagaaggaaatgggaagggatgggtggaaayggaaaa

SEQ ID NO: 10462 - DNA, 201 bp, Artificial Sequence
  Description of Artificial Sequence: Synthetic polynucleotide
ttatttgaaattgataggtttgttttttatgataatagttgttattaattagttttttttatatttttttatttatyggttttagtattttgtatatttygyggagaattygtttttggttttttatagagtatagtattagggtgtagattattatatttatagagttattagttatttggtgtatgtttttttyggtag

SEQ ID NO: 10463 - DNA, 201 bp, Artificial Sequence
  Description of Artificial Sequence: Synthetic polynucleotide
aaaatagtagttttatggaaaataatagaaaaaaattttattttagtttggtaattaayggttggtygggggaygtgttygygttgtttttttttyggtygttagggggygtaggaagaagttttggaggtttgtttygggatygygtattygtttttttttttygttagttttttttttattttygttgagtttygtttc

SEQ ID NO: 10464 - DNA, 201 bp, Artificial Sequence
  Description of Artificial Sequence: Synthetic polynucleotide
gtttgaygaagttttttttgggggtygatgttttttttygggtgggaaggggygttgtyggtgagggttattttggygtyggtttgygtygttygaagtygggggggaggggaggttttygtttagtaggggttaygttygtttyggaygggggtygygygggygtttaggygaygtattttygtyggggttygtgatygt

SEQ ID NO: 10465 - DNA, 201 bp, Artificial Sequence
  Description of Artificial Sequence: Synthetic polynucleotide
ttttgagaagtaatagatttygattaatgtgtatygttttygyggygtttygtygygttyggaatygttgtttatttggygttyggtaaggaaggttgtyggagggtttataggtgtttttttygttttyggagaagttyggtgtgggyggygttattttagaaaygttatyggygygtttgtttygagyggygggggyga

SEQ ID NO: 10466 - DNA, 201 bp, Artificial Sequence
  Description of Artificial Sequence: Synthetic polynucleotide
tttgttatttgtatttaagatggatttttygttgtygtygttgttttttyggtttttttgttattattttttaygttttgtagttttgttttttgtttaygggttgttaagtygyggtttggtyggtggtggtagtggyggagttagataaagttttygtttttttygttttagagttttttaggygttttaagtggyggg

SEQ ID NO: 10467 - DNA, 201 bp, Artificial Sequence
  Description of Artificial Sequence: Synthetic polynucleotide
ttttagggyggtygtttttattttyggtttttatttagyggggatttattagggygagggttgaagatttygygggaygtygygygtyggggatagygaygtatttatttttttagttatttgggaggttgtaggttygggtyggagttygaggtttaggggygygyggagtagttttggttaaggygtagggygyggggt

SEQ ID NO: 10468 - DNA, 201 bp, Artificial Sequence
  Description of Artificial Sequence: Synthetic polynucleotide
ttttggggtygggyggggyggggyggggtaggggggtygggygyggtttaygygttttttygagtgygyggtgygggaygggygyggttgaygygttttygtyggtgtttgtgttttttygtaggttaggagggtattttgygttgttattyggatttggygggtagygagttgtagyggggtaygtttayggtygagtyg

SEQ ID NO: 10469 - DNA, 201 bp, Artificial Sequence
  Description of Artificial Sequence: Synthetic polynucleotide
ygggtttggataggttagtttgagagtatgygaagtyggttttygggtagataataagagatatygtygggaagtgttaggaatttygygygttgttygyggggtttttttgtagtyggggttgggttagaaggatggtaaagttgygyggygtygttygggttggagtygtagtygaggagtygaagtttttttaggtyg

SEQ ID NO: 10470 - DNA, 201 bp, Artificial Sequence
  Description of Artificial Sequence: Synthetic polynucleotide
gattyggagttaygyggggygggggtyggtatygagggtygggaggygygaagggtaygyggyggygggaagyggggygattygaaggtttaygggggtygggaggttgyggggygttygggattttttttygggtggttatygtgyggtyggggygyggaagttagaggtgtttagaggygtygatttygtygaggttgc

SEQ ID NO: 10471 - DNA, 201 bp, Artificial Sequence
  Description of Artificial Sequence: Synthetic polynucleotide
tagtygaggtagaaattygtttygaggygygggygtygggttygggttttaaggatgygygtygggttttttttygyggggatagtygagtttygtyggygttttaggtgttttygtagtgygttygggygyggaygtttttttgttttyggaggggaagygggagggtttttggggtaaygtttygatttygggtttttt

SEQ ID NO: 10472 - DNA, 201 bp, Artificial Sequence
  Description of Artificial Sequence: Synthetic polynucleotide
tataggtgttttygtygtaggtttygtatatttatttatggtatttatataggggttygaagaatatgttyggtttagttaygtggtagatgtagaygtygtagtygtagyggtttyggtygtggtatagygyggttttygggggttgtttaggtgygyggtagygtygtttygattyggttygggatagtttgtaggygg

SEQ ID NO: 10473 - DNA, 201 bp, Artificial Sequence
  Description of Artificial Sequence: Synthetic polynucleotide
agatygttgtttggttattttaygtttttgagttttttatatagttagtttygtgattttygagtttygtgattttygagtttygtgatttttaagtttyggaagtygttgtaggtagyggtttagttaggtttygttttttttatyggagttttaygygttaattttagttaggtttygttttyggtygttttaggygtg

SEQ ID NO: 10474 - DNA, 201 bp, Artificial Sequence
  Description of Artificial Sequence: Synthetic polynucleotide
gtagtagtttatygaggayggggattygtaagtggyggaggttyggggttgggggtygtygggagggygggaygygygyggtttgggggtgggaggygtygggtttggagttygagtygggggattagygatgtagtygggygggygtygyggtatttyggggtttttgtatygtttygaaygttgtagggttgtagggtc

SEQ ID NO: 10475 - DNA, 201 bp, Artificial Sequence
  Description of Artificial Sequence: Synthetic polynucleotide
attttgtaggtygtatttttaattygtattttatttaggttttygtttggygtygatttgttttagtttaattttyggtttygtagattaggtatttttygggaygyggggtagattttgygttygggttttttttygtagtygggttgttyggtttttgygygygtataataggyggtayggygtagttttygggagygc

SEQ ID NO: 10476 - DNA, 201 bp, Artificial Sequence
  Description of Artificial Sequence: Synthetic polynucleotide
aggatggygatggtattggygyggattttttttatggtgggtagaygggygttttaggtgggggattgggtyggygtgttttyggggtyggggygggggygttygtagttttagttgtttgttttygttygygtttagttgtttagttttgtagagtagaaaaaggagagaggtgggggggygggggggtgatagggagag

SEQ ID NO: 10477 - DNA, 201 bp, Artificial Sequence
  Description of Artificial Sequence: Synthetic polynucleotide
ttagttttttttgagggagtttagyggtgygggttygtttttttttagtttagtttttttgatatygttttttttttggggaygttgtttgygggttygygygttttygttttygatttttttgtaggttttttygggggtyggggtaggatygtatttatygaggattygggygttggagttagtagtagyggtaygagt

SEQ ID NO: 10478 - DNA, 201 bp, Artificial Sequence
  Description of Artificial Sequence: Synthetic polynucleotide
taagtygaagtttttgaaggaggttyggtgttatttyggtgtgatygygtttyggygaygttgggtagggtgtagggagttagttyggtygyggtttagygggaggggagggggtyggtttygaattygggygttygggtygygggtgatttattgggaaygttaggttygygygtttagatyggygggygaygtttagyg

SEQ ID NO: 10479 - DNA, 201 bp, Artificial Sequence
  Description of Artificial Sequence: Synthetic polynucleotide
gggggttyggtttagggygggaaatgggtggggaggggyggggtttgggttggagattggayggaggagtygggyggagatgtaattggaggaagagggygggayggggyggagaaggtttttygtatyggyggagggagagggattaggagggggttgyggygggggaggagagggggttttyggtttagagattgaggc

SEQ ID NO: 10480 - DNA, 201 bp, Artificial Sequence
  Description of Artificial Sequence: Synthetic polynucleotide
gygatttttgttttttttttgggtygagyggtaggygygttygtatygttttygttttttygtygtagtygttgtygatyggttggttgggttttgyggygtgaggatttyggyggygtygtagtttygygagttatggtttagttyggyggggaggttyggttygggtttaagayggyggtgtagattygygtygttatt

SEQ ID NO: 10481 - DNA, 201 bp, Artificial Sequence
  Description of Artificial Sequence: Synthetic polynucleotide
tttatgaatatttyggggygygggagttygagygttgtyggagggygtttygggggaggyggtygttgatgtaagttyggygggtygttgggtttygttyggttgyggygggagtttygggaygggtyggaygggtyggggtagaggaggygaggygagttygygggtggttagttataaagttygggyggygagatagac

SEQ ID NO: 10482 - DNA, 241 bp, Artificial Sequence
  Description of Artificial Sequence: Synthetic polynucleotide
ttttatttttatatatttatattyggtygtttttygtttttttattygtttgtygygygygygygygatttygtttatatatagygygygygaygtyggyggagatygtttygtttttttagatygaaygtygttygttygtttgttgaggagyggygygygtttyggtttygtttttttggygtygyggygyggygggyggggggyggyggtyggaggagttgggggtygggttagygyg

SEQ ID NO: 10483 - DNA, 201 bp, Artificial Sequence
  Description of Artificial Sequence: Synthetic polynucleotide
ttttygtygttttttaggtttttagtgaggttttttagttggtygtttattatggtttttattatgaaygttatggttttygtyggtyggggtatygggygtttgttattaygygttaggtatygggtaygttygygtttattttagtattaggtttygyggatagttttygtygygggttygygttttaygtttggtatc

SEQ ID NO: 10484 - DNA, 201 bp, Artificial Sequence
  Description of Artificial Sequence: Synthetic polynucleotide
gattyggtatgaggagttyggtatttttgttttttagttttttggaagtttttttttggattggtyggygtygttttttygatatttgggggttgaggtyggtatttygggtttgygtggaggggygagygttaaggttgygagagtygggtttygatttgtaattattttttttaatttttatggagtttygtttygygt

SEQ ID NO: 10485 - DNA, 201 bp, Artificial Sequence
  Description of Artificial Sequence: Synthetic polynucleotide
gygttyggtagagagtttttagtygtttyggatttygygtagtttygtagagaygygygtgtygttygtaygggtyggtattygggtygttttygtyggygtgttaggatttygtatagaagygttyggaygyggaygtaygtagtygyggttaygattttygtygttygttyggttygtgttyggttttggttagtaggg

SEQ ID NO: 10486 - DNA, 201 bp, Artificial Sequence
  Description of Artificial Sequence: Synthetic polynucleotide
ttttttyggttttttttttatttttygttttyggggtttttttttgttgagygggggttgtygggatttgggattgyggggttgtttygatttygtagtygttygyggtggaagttagttygggtttggttttgagygygyggttggggyggtygttgtttatggtgttggygygggtggygygtyggtyggyggggtttg

SEQ ID NO: 10487 - DNA, 201 bp, Artificial Sequence
  Description of Artificial Sequence: Synthetic polynucleotide
tygttygygtattggggttttygaggtgtgatgttatttgttygtagaatyggtttttttygygtygtttttttygygtttttattttagtttttttttygtygttttyggggttaatatggtagyggygtygtygttttattttygtaatygtaygattyggttggtagggtygtyggttyggattttygagatttatat

SEQ ID NO: 10488 - DNA, 201 bp, Artificial Sequence
  Description of Artificial Sequence: Synthetic polynucleotide
tygygggygyggtttttggaayggattttttttygagtygygttygtygggtygtttttttttygttygtagatttyggttyggtttygtygtygygygygttttttttygttttggttttttttttttygttttygggtttyggygttttygttyggttygagygygyggtttgtttygttyggtttattatggygyggt

SEQ ID NO: 10489 - DNA, 201 bp, Artificial Sequence
  Description of Artificial Sequence: Synthetic polynucleotide
ggttaggttttttaggagtagttggggaatattyggygattttggyggttgttttttggtggygtagggagttygygtgtttgygagtgygtgtgtgtgygaagtttttygggtaagtgtgttagygygygtttgggtgtgtgtaagggtgtgagygtgtataygtgggtaygggygtgtgygygygggggtgttyggttg

SEQ ID NO: 10490 - DNA, 201 bp, Artificial Sequence
  Description of Artificial Sequence: Synthetic polynucleotide
tttygtttttattygttttttttatygygtygttttttygttttgttttgygggtttaggyggaattyggaayggtygtttttttttttygtttttygtygtygttttttttttttttttttyggttttttttttagtttygggtyggagyggggtgtyggyggyggtyggttygggyggyggygtttggttatgtygtgt

SEQ ID NO: 10491 - DNA, 201 bp, Artificial Sequence
  Description of Artificial Sequence: Synthetic polynucleotide
ttaagttygttgggygttygtttttgygtatygygttygtttttttygtttgtgygtttgggtttyggygtaygtattgtatttgtygttygtttttgtygtgtgtgtgtattgtyggggttygttygtttaygttygygygtgygtttttatttttatttygtattygygtgtaygatttattygtygtygttgtgygyg

SEQ ID NO: 10492 - DNA, 201 bp, Artificial Sequence
  Description of Artificial Sequence: Synthetic polynucleotide
tgtygaatgaagttgagygttttagtggaattagggattttaggggtgagygatygygaggggagagygaygaaaagggyggtyggagttggaggggygyggagttaaataaaaaagggyggtyggagttgtaggggygtygagttaaataygttatttttagatggggggttttaggygagttgtttagtttttttgagg

SEQ ID NO: 10493 - DNA, 219 bp, Artificial Sequence
  Description of Artificial Sequence: Synthetic polynucleotide
cgtttgtttcgtcgttcgtatcggtttagttttcggcgttcgttcgtttttttcgttcggagcgttgtgagttaggagtagtcgtaggtttttcggacgcgttcgtcgcgcgtattacgtggttcggaggcggtcgttagtttgcgttcgcgatcgggggcggacgttgtattatcggttcggagttgggtaggggaggtttttcgttttttttttagg

SEQ ID NO: 10494 - DNA, 315 bp, Artificial Sequence
  Description of Artificial Sequence: Synthetic polynucleotide
gacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcg

SEQ ID NO: 10495 - DNA, 201 bp, Artificial Sequence
  Description of Artificial Sequence: Synthetic polynucleotide
cgcgtcgttttagcgttttgtagcggaggcgtcgtttttatttcgatcgtaggttcgttcgggtcgttcgttcgtcgggtatcgagtcgttttgtcgcgcgttgcgtttcggggcggggtgggaggagagggagtagtcgttattttgtttaggtcgtcgcgggttagttttgtagttagttttagttttgggtcgggtgt

SEQ ID NO: 10496 - DNA, 201 bp, Artificial Sequence
  Description of Artificial Sequence: Synthetic polynucleotide
gttcggagcggtcgtgaggggcggacggggggtttcggggcgggtttgtaggttttggggatttgaggttgtcgggaggggttgttagggggcgttggtcgggcgtcgggttttgcggagttggggcgtcgatttttgattcgcgagaggggcgttttcgtcgtgttggtcgtagttgttatttttagcgtttttattatt

SEQ ID NO: 10497 - DNA, 201 bp, Artificial Sequence
  Description of Artificial Sequence: Synthetic polynucleotide
cggcggtgattgcggtttcgcgcgcggttcggtttaggtaggattcgaagcgcggtttcgggcggcggcggcggcggcggcggcgtggtttcgttcgggcgggttttgcgggataagacggggagtcggttacggggtggggcgattggcgtttcgggagtaggaggagaatcgcgggtaggcgggcggggagggtgcgcg

SEQ ID NO: 10498 - DNA, 201 bp, Artificial Sequence
  Description of Artificial Sequence: Synthetic polynucleotide
aagtttttcgtttagttttgtcggttcggtttgggcgttgtggatcggtaatagtagttttattaggatgtaggtcggattaagtttttggggaaaattcgttgtaataattgttttttatatataatttttaattttttttttattttcgtttttaattcggagatttgtaaagtttaagaaagggaaaagtaattttat

SEQ ID NO: 10499 - DNA, 201 bp, Artificial Sequence
  Description of Artificial Sequence: Synthetic polynucleotide
tagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttg

SEQ ID NO: 10500 - DNA, 201 bp, Artificial Sequence
  Description of Artificial Sequence: Synthetic polynucleotide
ttttatgacgtcgaattgtttgggggatcgttagcggtgcgtcggtcggagttagttggtggcggggcgggcggttcggagtgtttgtttaattttgagcgttcgcgagggggaggggaggtagttggttacgggttagggggtagtaaggtggaggagcgggggttgggaaaggggagggtatttttcgggttgtttgtt

SEQ ID NO: 10501 - DNA, 201 bp, Artificial Sequence
  Description of Artificial Sequence: Synthetic polynucleotide
ttttttcgttttagttagacggggcgttcgcgttttttttttcgtttcgcgttggtttttaataggaagtcgtttcggtttttagtacgtgatttttatcgtatttgtatatcggagggcgaattggttaatcggtattttgtatttgagtttttttttcgcgcgtttttttcggtttattggtttttcggttaggttacg

SEQ ID NO: 10502 - DNA, 201 bp, Artificial Sequence
  Description of Artificial Sequence: Synthetic polynucleotide
gtcgttatcgttatcgtagttgtagcgtttttttatatttttagcgcgtcgtcggtcgggtagtttggtcgcggtacggaggaggggttttggagggggcggtcgggggaggcgacgtcgagttatcgttttcgggtagtcgtcgtcgggggggagcgcggagatttgaaagggcgcgtcgggtaacgttttttttttttt

SEQ ID NO: 10503 - DNA, 201 bp, Artificial Sequence
  Description of Artificial Sequence: Synthetic polynucleotide
ttattgttttttgggcggtgtggattagttgtagagtgtgatttgcggttagggagtgttttttcggagttttcgtttttagatttttggtgttaaagacgttttgtgagcgggtggggtcgggcgttttagttacggcggtcgtcgtttttttttttcgtaggacgggatagcgtttttgtggatcgcgttttagatggg

SEQ ID NO: 10504 - DNA, 201 bp, Artificial Sequence
  Description of Artificial Sequence: Synthetic polynucleotide
cgtggaggcgataggcgtcggcgataattttttagttcgggcgtcgcgcgtcgtttcgcgggacgcgtattggggatttcggtcgtttttttcgtttttcgcgcggatataaagttcggtagtcgcggcgtttagagggtcgagggttatcggatagttcgggtagattttggattcgtttcgcgggagttgtttttttgt

SEQ ID NO: 10505 - DNA, 243 bp, Artificial Sequence
  Description of Artificial Sequence: Synthetic polynucleotide
aaggttggagggtgttagaaagatgatcggtcgggtacggagcggggagttcggagtcgcgcgtggggaggggaggtggaggagggggcgtcgggggagcggggggcgcgtgaggggtgcgagcggggttcggggggcgcgcggtgggtgtggggggcgtcgggtttatttatttttcgttagcgtcgttattgtcggttatatgattgaggttgttgttgggatgacggttcgggttttagt

SEQ ID NO: 10506 - DNA, 201 bp, Artificial Sequence
  Description of Artificial Sequence: Synthetic polynucleotide
ttttgtatttgtaatttttcggggtagtgatatagttggtttcggtgttttggcggagggtagaagtgatggtcggttgcggttttgtagggtgagaatcgggttagataagtgagtgttttagagtcggggagttgtatacggaggggagggagtggcgggcgttgcgtcgggtttttttaggaagaggtgagcgggttg

SEQ ID NO: 10507 - DNA, 201 bp, Artificial Sequence
  Description of Artificial Sequence: Synthetic polynucleotide
cgaatgtggttaagggggtcgtttagatgggtgtagatacggttaagatcgtgttgatcggtattaaggatattgtttgtagtggggttatcggtgttgcgaacgtggttaagggtgttgtgtaaattgggttgaaaacgatttaaaatatcgtaataggtataaagaatatttttggtagtggggtgatcggtgttgcga

SEQ ID NO: 10508 - DNA, 201 bp, Artificial Sequence
  Description of Artificial Sequence: Synthetic polynucleotide
gtcgcgtttttgggaacggttagggaagtaagtagaagtcgggaagtcgcgaaagaggcgagaaagtgcgattttttttttagattttcggtttttcgtcgaaatttttgtcggtcggttaaattttagataatggaagttttacgtttttatttttatttttttttataagttcggtcgcgggtttttttcggttcggga

SEQ ID NO: 10509 - DNA, 201 bp, Artificial Sequence
  Description of Artificial Sequence: Synthetic polynucleotide
tgtgacgattttttaagggggttttgtgagtattttttttttatagttaggaaattgaggtatagaagggagggattgtttggtaggagttaatagaggcgtatagagtagcgtgatgagtttcgggttttgggggcgggttcgcgagtaggtagtttttattttatggtggatttttaggtttttttttttgtttcggtt

SEQ ID NO: 10510 - DNA, 201 bp, Artificial Sequence
  Description of Artificial Sequence: Synthetic polynucleotide
tacggagtttttttacgcgtttattgcggtttcgtcgtgttaaggggagtttggttgtttacgggttttatttgttagcgagaagatagtttggtcgggcggttgattttattttgtaattttgatattgtgtttttcgggtttgtcggttttatgatttgtgtttaaagtttgatttttcgtagattaggtaaaagttaa

SEQ ID NO: 10511 - DNA, 201 bp, Artificial Sequence
  Description of Artificial Sequence: Synthetic polynucleotide
ttttgtgtttttacggcgcgtagaggcggcgtcgcgaattttgtgtgtattttatacgacggcggggattgaggtttttcgtagtttagagtcggagttcggggtcggtcgagttcgtaggatcggttttttcgtcgatttttacggttttatttagttttttgggtttatggcggcgtcggcgttggtgagtggagggtt

SEQ ID NO: 10512 - DNA, 201 bp, Artificial Sequence
  Description of Artificial Sequence: Synthetic polynucleotide
ttatcgtagtcgatagttttataaatattatcgttcgtttagttttcgttttttcgggtcggttgttatttcgcgttttcggtttggttttggtttcgtcggttgtattgtacggttcgttttttcgtttatttgtttattaattttgtagacgttttgtgtttattttttttttttttttggttattttttttttttgtt

SEQ ID NO: 10513 - DNA, 201 bp, Artificial Sequence
  Description of Artificial Sequence: Synthetic polynucleotide
ggcgtttttttcgttcgtttgcgggttcgttgcgttagtcgtcgtaataaagtttgatagggcgtggtttcgcgggaagcgggttcggcgttgttcggtcggggcgtaggcggttcggttcgggttttttcggtagcgtcgagtttagggttttttaattcgttatcgtcgtcgtttgtttcgtcggggcgttttagtttt

SEQ ID NO: 10514 - DNA, 201 bp, Artificial Sequence
  Description of Artificial Sequence: Synthetic polynucleotide
aaaataaaggatgggtgaataaattgagattcggtttgttgggcgttatgtggagatcgtgtgtaggaagagttaagatattagagtcgggggggtttcggtgatttttgtcgttttttgtattttgggtttatggttggggtttgtttttttttagttggtagtgttattttttttgtgttttattaagtttattagtaa

SEQ ID NO: 10515 - DNA, 201 bp, Artificial Sequence
  Description of Artificial Sequence: Synthetic polynucleotide
tgtcgtggtttcgggttattgtagtttttttgtttcgggttttcgtggtttttttgtttcggtttgttaagtgtttgggattgcgggcgggcgtcgttacgtttgattggtttttgtatttttggaggagacggggtttcgttttgttgatcgggttggtttttggtttttgatttcgagtggtttgttcgttttggtttt

SEQ ID NO: 10516 - DNA, 233 bp, Artificial Sequence
  Description of Artificial Sequence: Synthetic polynucleotide
agtattcgatttgtgaaaattacgtttatgtagtaatataattggttcgaaagcgttaaagagttaattaagaggttttcggtttttcgtagtttatagcgtagttcgattttttagagtcgtcgagtagacgttcggtgaattttagaggcggcggagggtggcgaggagttttcgttttttttcgtttttttttttttcgatttcgttttttttttttttttttttttttt

SEQ ID NO: 10517 - DNA, 201 bp, Artificial Sequence
  Description of Artificial Sequence: Synthetic polynucleotide
tcggagttgtagtagaagcgttttcgatttcgtttaggtttttagtttatttttttttgaaggtcggtagggggcgttattatcgttggttttttcgcgcggtttcggttttcgtttcgggaatcgagtgtttgtagttcgcgattttggggaggtatagggttagggtatcgtttcggcggagaaagtggttgtgtcgcg

SEQ ID NO: 10518 - DNA, 201 bp, Artificial Sequence
  Description of Artificial Sequence: Synthetic polynucleotide
gggggacgggttagttagggtaggagtttaaggatatgaggtaaagattttaggttgggatttttcgtagttcggaggcggggggtggggagggagggtcgggggggtgttgggcggagacgttgggtattggggttagcgttgggtagttatgtacgggggcggggtaataggtaggttagttgttgttgttttttagga

SEQ ID NO: 10519 - DNA, 201 bp, Artificial Sequence
  Description of Artificial Sequence: Synthetic polynucleotide
aagttcgtgtagcgcgcgtcgttttattaacgcgtttcggcgtaggcggtagaggaaagcggtttttacgcgcggcgttcgcggtttcggggttaggggcgcggttagtagtgttagtacgttttttattacgtcgtcgtcgtttttttcggcggtggtcgagatcggggcgaggttcgtagcgatcggttcggcggggtt

SEQ ID NO: 10520 - DNA, 201 bp, Artificial Sequence
  Description of Artificial Sequence: Synthetic polynucleotide
taggaatgagtttgttgagggtttagtttcggggtcgggagtttgttgtaaaggatatgaaaaatttttattattatttttgtatgtgaaaagaatatgcgtgttggaaataattttttaatttatatatttttaaatatttgtttagatttataggagaaatatttttattgatttttgtataaagtgtattggaggaaa

SEQ ID NO: 10521 - DNA, 201 bp, Artificial Sequence
  Description of Artificial Sequence: Synthetic polynucleotide
ggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgag

SEQ ID NO: 10522 - DNA, 201 bp, Artificial Sequence
  Description of Artificial Sequence: Synthetic polynucleotide
agtttttaagggaggaggggagagttgtagagaggaggaggggtcggggaggtcggttttataaaggcggttggaataattttgttcgttagatttcgtcgttcggattttttgagttgttcgttattttacgtgatcgcgtcgttttttagttttatcgttgagtgagttggggcgcgtttttatttcgtttttagtttt

SEQ ID NO: 10523 - DNA, 201 bp, Artificial Sequence
  Description of Artificial Sequence: Synthetic polynucleotide
gaggagtagtagcgttcgtcgggggatgtagtagcggtagcggcggcggcggcggcggtagcggtagcggcggcgcggagttttttgcgtttagcggttcggtcgggttgcggtagaggcggcggcggcgtttcgtttcgggtgaggttgtcggggtcgtgcgcgttggtgagtggggcgtggggggtaggtgggtggttg

SEQ ID NO: 10524 - DNA, 201 bp, Artificial Sequence
  Description of Artificial Sequence: Synthetic polynucleotide
gttcggagaagtggatttcgttttatcgagaggttagggtttttatgttttcgttttcgatttcggtttagtggtttttgtttttcggattgttttcggcggggcggggttgtatttcggagttttagtttatttcgtagtttttttcgtatttgatattatcggttattttttataatatggcgttcggcgttttttaaa

SEQ ID NO: 10525 - DNA, 201 bp, Artificial Sequence
  Description of Artificial Sequence: Synthetic polynucleotide
ggaatttggaggaatatggcgttgtcgttttttggcggaagcgttcgggtttgcgggtaggggtagttttttagggttcggaggcgtagtgaattttcgcgagttcgtagttcgagtttcgcgttttcggcgtttttgagttcgtttagcgttgtttgcgtttttttttttttttcgttcgtcgttttttttttttttttt

SEQ ID NO: 10526 - DNA, 201 bp, Artificial Sequence
  Description of Artificial Sequence: Synthetic polynucleotide
gttagggatcgttttttattgttttttggttgtcgaggagcggttatcgggttcggttttagtttttttgttttgatttttttttttaagtttttatgtcgagttggagagcggtttttgagtacgtatgtggttcgaaaggtggtagttggtcgggtttgggttttttatgtgatttagttatgcgagggatcggttgaa

SEQ ID NO: 10527 - DNA, 410 bp, Artificial Sequence
  Description of Artificial Sequence: Synthetic polynucleotide
agatatgttgggttagtagtgttggttttattttagattttttttagttttttttagttagtcgttaaggggtttttttaatcggaaatttttaattcgcgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcgcggtgatttcgttgcggatcggttcgcggtgattttagcgcgaacgagttggttgtcggttggggcgagaaaggtttgcggatcggtttgggcgtatgcg

SEQ ID NO: 10528 - DNA, 201 bp, Artificial Sequence
  Description of Artificial Sequence: Synthetic polynucleotide
gagttagagatgtatttttggtcggtttgagtatttgcgggaattttgtgagtttttgaggtttattttttgttttttattttttttttttgtaaatttcgagttcggggtaaagttgttttttttttttatatttttttttaattcgataattaacgttttttagttttcgggaatgggacggattttttttaaggattt

SEQ ID NO: 10529 - DNA, 201 bp, Artificial Sequence
  Description of Artificial Sequence: Synthetic polynucleotide
gggatttttcgtttttcggtttagggggtatttatttcgtacgtggagttcgggtagcgtttttagacgtatttagcgggatatcggagaggacgtcgacgtagtgtaacgtttcggtcgaagcgtcgaataatatgcgcgcgtcgcggaggaggtgcggggcgtgttcgtttaggtagcgggtcgtttcgacgtggtaga

SEQ ID NO: 10530 - DNA, 201 bp, Artificial Sequence
  Description of Artificial Sequence: Synthetic polynucleotide
atgtgttttgtcgagttgatttgtttagtttattttttattttgaaacgacgttaagtatgaagaagagttgtataaataatgttaataatttcggtgtcgtttttatgggggttatggtggttttagtgtattttatatgttttttttttttttgtttttttttttcgtgtatatatatattgttttttgatttaagagt

SEQ ID NO: 10531 - DNA, 201 bp, Artificial Sequence
  Description of Artificial Sequence: Synthetic polynucleotide
gtgattttgcgaggttatatttcgggtgcgtcgttgcgggttcgtgggttcgtgggttgtagtttttcgtttttgtcgggtggacgagtttcgggttcgcgtggagttgttcggttaaggtcggttcgggaggggcgcggcgtagggcgggtaggggcggggttttaggttaacgtttagttttagatttagtttcgtcgt

SEQ ID NO: 10532 - DNA, 201 bp, Artificial Sequence
  Description of Artificial Sequence: Synthetic polynucleotide
ggagggagaaagggagagagttttagtcgtttcggttgtggtaggaggagttttaagagcgtttttcgagttcgtttcgtatttttaggtttagttcggcgtaggttttttttttcgttttttttattttcgttagttgttgaaatttttttatcgttttttcgcgggtaatagtgttcgttaggcgtcgtcgcgcggtgt

SEQ ID NO: 10533 - DNA, 201 bp, Artificial Sequence
  Description of Artificial Sequence: Synthetic polynucleotide
gtttttaatgcgggcggttttcgtattttacgcggttcggggtttttgtttatttttcgcgggcgggtttcggatttttggggttttttagttttttttcgtttttttttcgcgtcggtttcgtgttttgcggttcggcggtttcggcggcgcgagtcgggggaggcggcgaggggtgttttcgaggttcggcggcgcggt

SEQ ID NO: 10534 - DNA, 201 bp, Artificial Sequence
  Description of Artificial Sequence: Synthetic polynucleotide
ttcgtattttttttgatttttatggatatttagttaatagtaggaataaaaattaagatttttttttttttattcgtttggatatttattttttcggttcgcgtcgtcgtgttttttattcggttatatagcgattttaaaagtttagtttttatttcgcggagatttcgatagttttgggaggttttttttaaaagggaa

SEQ ID NO: 10535 - DNA, 201 bp, Artificial Sequence
  Description of Artificial Sequence: Synthetic polynucleotide
agtcgttcggttgacgtgataagggaggtgtaggttaatacggcgatttcgcgttttttggcggtagtgtcggagtagcggcgttgtttttgatttattcggtattcggttttcgggatcgtttggcggttgtgaatgtagagttggggcgacgtggggttcgttttttgggattgggtgtgagtttgcgtagtgagttat

SEQ ID NO: 10536 - DNA, 201 bp, Artificial Sequence
  Description of Artificial Sequence: Synthetic polynucleotide
aattgaacgtttgaaacgaaggtggcgcggtttggataaatttgatttttcgatatttttcgtttttgcgttcgttttcgttaagcggggaggagcgatcgttataatggattttttcgtaggttttgtgcgcgttgggaatttagttgtcgtcgtttcgtagagttttttgttttcggagggcgtttattttcgggtcgt

SEQ ID NO: 10537 - DNA, 201 bp, Artificial Sequence
  Description of Artificial Sequence: Synthetic polynucleotide
gtttcgggcgtttgttgtttcgtgtttttatcgacgattttatttagttgcgttacgcgtcgtttcggttgtcggtcgcgcgttttgttcgtcggttttcgttcgtaatcggcggtttagggcggattcgggtttttgcgttttcgcgagaagcgcggcgttgcggggtcgtgggcgtttgagttcgcgcggttttcgagg

SEQ ID NO: 10538 - DNA, 294 bp, Artificial Sequence
  Description of Artificial Sequence: Synthetic polynucleotide
ttcgtcgtttatgtttttattgtaaggtcgtagttttcgtcgtcgatttcgatttttcgtttcgtttagtcgcggtttcgttcggcgtttttttttcggtggaagtttaagtttaattaattgagttcgaggcgggagggaagggttttgcgcgtcgtggttcgtttcgtttttttttcgcgttttttttttcgttttgggtggtatttttttcgtcggtatttataataagtcgttgattaatgaggtcggggtcgttttatttcgttcggtcgggtcggggttttcgcggga

SEQ ID NO: 10539 - DNA, 201 bp, Artificial Sequence
  Description of Artificial Sequence: Synthetic polynucleotide
taagtttatagaagagtaaatttttatttttcgaggttgttgtggaagttatcggggttgggatagtagagaggaatttagacgggaatatcgttttttcgttagattttcggcggtttttttttttttttttaaatttatttttaaagttaagtgtaggttttttcgttttagttagaagcgttgcgtgagtttttatac

SEQ ID NO: 10540 - DNA, 201 bp, Artificial Sequence
  Description of Artificial Sequence: Synthetic polynucleotide
gaggtttacgttttttagatcgttatagtcgttgttatagggtttgagtttgggcggcgtttcgtttcggtcgtacggtgcgtcggcgttaatttttttcgaaggtttcggtagttaagattgtaggtttttattaagtattgttttcgaattgggttacgagagcgtgtttttgattggtttgttttggaggttgggaag

SEQ ID NO: 10541 - DNA, 201 bp, Artificial Sequence
  Description of Artificial Sequence: Synthetic polynucleotide
tttttcgcgcgtcgttttttttcgtcgtcggtcgcgtgcgttttcgttttttttttcgcggcgggagtattttcgttcgttatttggggattcgcgtcgcgtttttcgttttcgttcgttcggcgtttatttttcgcgttttttgttcgttggggttataattgttttttatttttcggaggggttattttgggggtggtt

SEQ ID NO: 10542 - DNA, 201 bp, Artificial Sequence
  Description of Artificial Sequence: Synthetic polynucleotide
gcggtttcggtgagcggggcgaggggcgggtgggtagcggcgtcgggggaggtcgaggaggcgaatggtggtgtcggggcggcgggtatcgggcgaggtcgcggttagttttttcgggtcggagttgggtatcgcggggacggggagtgtcgggggtaggtgaggttagggtaggagtttacgcggtgggtgcgaaggttt

SEQ ID NO: 10543 - DNA, 201 bp, Artificial Sequence
  Description of Artificial Sequence: Synthetic polynucleotide
ggaggcgttgcgttaggcggaggaggagcgtaaggttaagtacgttaagatggaggcggagcgcgaggtcgtgcgttagggtattcgagataaggtgcgcgtcgggtcggtttcgtttgcgggaaggcggttttgagtttagcggggatttagatttcgtttgggtggaaggggttgttcggaagaggggcgggcgttttt

SEQ ID NO: 10544 - DNA, 201 bp, Artificial Sequence
  Description of Artificial Sequence: Synthetic polynucleotide
aaagagaaaagaaatagataaaattagggtagggggtaaaaaagtttttcgcgtttttcggaatttagcggtcgcggtcgcggttatcgtcgtcgtcgtcgggggtgggtttcggaagagtttgtttagtagggaaggggaggacgggttaggagcgaaattttgtaggcgaggaagggatagacgcgtaaagaaaaagtg

SEQ ID NO: 10545 - DNA, 201 bp, Artificial Sequence
  Description of Artificial Sequence: Synthetic polynucleotide
cgcgggcgtagcggcggtcgggtacgaggtcgggttgatattattatttgttggggcgcgggaagaacggtagttgttttgcgttgtttcggcgagggacgtttggaaaaggttgaagttttgggcgtttttaagttcgttatttacggggttttcgttattttagtttgttcgtcgtcggtcgttttttgtgattttttg

SEQ ID NO: 10546 - DNA, 201 bp, Artificial Sequence
  Description of Artificial Sequence: Synthetic polynucleotide
ttttttagggatggttttgtgtttgggttttttttttttttaaatttcggggtggtttttgttttattagattgaatcggttttaaggagaaaagttgacgattattttgttttagttttcgggaagttttgttttataaagaataagagtttttggttttgtgaaatgagttataggttgttttgattatgtttatttgg

SEQ ID NO: 10547 - DNA, 201 bp, Artificial Sequence
  Description of Artificial Sequence: Synthetic polynucleotide
ttttaaatttcgatcgtcggtttggcgcgcggttgcgtttatcggtttcgcgttgttgtcgtcgttatcgttatttcgtcgtcgtttcggttcgcgggtcgtttaggttagtattcgggtcggtttgttttcgtcggtcgttcgggtgttcgtcgtcgcgtcgcgtttcggtcgggcgtggatggagggcgtcgcgcgttt

SEQ ID NO: 10548 - DNA, 201 bp, Artificial Sequence
  Description of Artificial Sequence: Synthetic polynucleotide
cggtcggatttttttttagattgtttgcggtttgaaggggttaggttcgcgtaaggttttaggttgtttgggcgtcgggtcgtattgttaggagttgttcgggagtggttttttaggaatattaggtattgattatatattaggggttgggaaattaggtggtttgtattaaggcggtttcggggatttgtttgtggtaag

SEQ ID NO: 10549 - DNA, 463 bp, Artificial Sequence
  Description of Artificial Sequence: Synthetic polynucleotide
agcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgt

SEQ ID NO: 10550 - DNA, 201 bp, Artificial Sequence
  Description of Artificial Sequence: Synthetic polynucleotide
ggggacgttagtggattggagtcgcggagtttcgagggaaaaattttgtaggcgtcgcggtcgggattcggttacggttttagtttattttagtaggtgcgggaggaagaggtagcgtcggagtttcgaggttagagagtttcggcggcggcggtcgtttttttttttcgagttggtttgaagtcgttgggtattttcggt

SEQ ID NO: 10551 - DNA, 201 bp, Artificial Sequence
  Description of Artificial Sequence: Synthetic polynucleotide
agggttgggaggatttgtagtttttttgttggttttttttttttaggaagtcggttagtttggagtcggttgtttatttcgatttatttttcgtttgggcggagtaggaatgtggaagttggttcgaaaggattgtgtttttttttcgttaaatatttttttttcgcgttttttattaagttttggtcggggttgtggagc

SEQ ID NO: 10552 - DNA, 201 bp, Artificial Sequence
  Description of Artificial Sequence: Synthetic polynucleotide
agggcggagttttcggggtagaggcgtttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttt

SEQ ID NO: 10553 - DNA, 201 bp, Artificial Sequence
  Description of Artificial Sequence: Synthetic polynucleotide
cggaggaggttgcggggggtttcggtttaggcgaaggaagggtaagaggttgttcgatcgggggcggcgtcgggaggtgggtgggtttaatatttaggtcgggggaggggtttaagagatatcgggaagggtagtcgagttttaggggcgggtggggtggtagttgtgtgtagtaggggatagggttgggtttttggaagt

SEQ ID NO: 10554 - DNA, 201 bp, Artificial Sequence
  Description of Artificial Sequence: Synthetic polynucleotide
tagtcgatatgacgcgcggcgtagttaatgggaggcggagttggcgttttttggtcgggggggggtcggaggggtgggtttcgcgttttcggtgtttgtcgtgtttattgaatggagagagcgagcgtcggttagtttattcggtcgtttcgtgttttagtcgtagtcgtcgcgttttttagtttagttttaagtcggatt

SEQ ID NO: 10555 - DNA, 201 bp, Artificial Sequence
  Description of Artificial Sequence: Synthetic polynucleotide
ttttttttaagtttttttttggggattgatattttattagtatagagattaataatgttagataagagatttttgattttatatttggggttttcggaacgatgtttgggagagaaaatatgacgttttttgtagaggcgaattttagttcgggaggagggaggtcgttgggatgtgtcgtcggcggtttttgggttcggt

SEQ ID NO: 10556 - DNA, 201 bp, Artificial Sequence
  Description of Artificial Sequence: Synthetic polynucleotide
agattggattcgaattcggtttattttattcgagcggcgacgttagcgttgattttaggcgtgtttcggttttcggcgcggtttcggtttaatcgtgtacgttcgcggaaggtttcgtattcgcgttagaagtggtttgttcggggttatcggttcgtaagttttcggtgttttcgaggtttttgtttcgtttcgcgcggt

SEQ ID NO: 10557 - DNA, 201 bp, Artificial Sequence
  Description of Artificial Sequence: Synthetic polynucleotide
ggggttggggagggttgtcggcggcgcggcggggtcggcgggaggcgggaggttgcgcgcggcgcgggagcgtgcgtcggggttagtaggggcggggttcgcgcggtcgtcgggattggaggcgcgggggtagcgggtagggtattttgagggtatattttcggttatttggcgggagatttagttttgtcgcgcgtcgtt

SEQ ID NO: 10558 - DNA, 201 bp, Artificial Sequence
  Description of Artificial Sequence: Synthetic polynucleotide
gtttcggtcgtcgggcgcgtagtcgtttttttcgcgttttgttcgtttttatggtattttttaggaacgggaagggggtgggagtcgagtcggcggtcgcgtcgcgtcgaatgtgtgttttttttttcggttgtttacggcggtcgaggcgtattgtattttgttggcgtcgaagggtgttttggaatagtagagggagga

SEQ ID NO: 10559 - DNA, 201 bp, Artificial Sequence
  Description of Artificial Sequence: Synthetic polynucleotide
tttagtgttgttcgggcgttttttcgtagtagttttagggcgaggaggatggggggggttttcgtaggggttatattgtcggagttttacggattcgggcgggacggtgaggtttttatattgagtcggtggtaaagttttcgcgaggatgaaggaggaatttcgtgttttttattttattaggtttcgtattttttggtt

SEQ ID NO: 10560 - DNA, 258 bp, Artificial Sequence
  Description of Artificial Sequence: Synthetic polynucleotide
ttttttgggataagaagtggagtggggcggttaggacgcgggtcgtggggatcgcgagggaggagggggcggtcgttcggatttatttcgtggggttttcgcgcgcgggcgtttcggcgtgtcggattatgtcgtcggtagtttcgggacggggaacggaggcgtttaggcgtcgggtcgcgcggaacgcggagtttcgggcgttcgtatgtttttggttttggttttttggaagggttaggtcgtcgttgtcgtcgc

SEQ ID NO: 10561 - DNA, 201 bp, Artificial Sequence
  Description of Artificial Sequence: Synthetic polynucleotide
ttcggtcgttacgtttttttcgagggtcgtttcgttttcgtcgggtttcgcgagcgcgcggtgggggaggggagggtttcggagcgcgtttgcgtggggcgggggcggtagtcgattaggggttgggtttggtcgtttagggtcgggttttggttcgtcgtttacggtgcggagggttggtgggttttttttggtcgtcgg

SEQ ID NO: 10562 - DNA, 201 bp, Artificial Sequence
  Description of Artificial Sequence: Synthetic polynucleotide
tagtagttttttagagttttggtttggtagggaggggacggcgttcgagtagttatattgtagtttttcgggtttttttttcggtcggcgtaggtttcgcgtttacgattttttttgggagtcggatttgttttttttatcgtcgttattcgtcggtttttgcgttttttggttttcgatatttcgtttggtcgttttttt

SEQ ID NO: 10563 - DNA, 201 bp, Artificial Sequence
  Description of Artificial Sequence: Synthetic polynucleotide
ttttcgcgttatttcgggttcgttttcgttcggttttttcggagcggtcgcgtttttagtcggggagtttaggggttttggttcgcggagtcgggcgcgcggggggcggttggggtcgtagtagggggaggttcggcgttcgtagtcgtcggcgcggggtttatcgggcgtgtgggtttatttcggtcggggcgcgacggg

SEQ ID NO: 10564 - DNA, 201 bp, Artificial Sequence
  Description of Artificial Sequence: Synthetic polynucleotide
gggtttttagtacgcgttttagcgtcggagtagggttagggtttttttgcgattcggtttcgttttagatttttttagttttcggtcgcggattcgggtcgcgtgtgagcgttttttgtattttttatttttagggttcgtcgagagttacgattttttatagaaaatgagcgataaagagattttgtattgttttgattg

SEQ ID NO: 10565 - DNA, 201 bp, Artificial Sequence
  Description of Artificial Sequence: Synthetic polynucleotide
tcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggta

SEQ ID NO: 10566 - DNA, 201 bp, Artificial Sequence
  Description of Artificial Sequence: Synthetic polynucleotide
ttcgttttattttttgtttgttttcggttgttagagatttaggtgtagagagattttagaggtggcgttcggggttttggcgttttttttgcggacgttcgttgtagagtaggaagtcgtcgtttcggggcggaggggcgagtcgggttagggggtcggggtggagaggtttgtagggtttgcgcgttttttttattcgcg

SEQ ID NO: 10567 - DNA, 201 bp, Artificial Sequence
  Description of Artificial Sequence: Synthetic polynucleotide
agtattaggttcggtttttcgtatatcgtttcgaatttcgggggtacgggcgcgggtttttcgggtttttcgggggacgcggggtttttaagttaaacgcgcggttcgggggacggcgtcgcgggttttttcgggtacgcgcgttttttaggggacgcgagttttttcggggacgcggcgttcgcgttgtcggttttttat

SEQ ID NO: 10568 - DNA, 201 bp, Artificial Sequence
  Description of Artificial Sequence: Synthetic polynucleotide
ttttcggtcgaggaggggtcgcgtggcgtcgcggggggcgggtcgcgtacgtttttcgtagggaggatttagggatagttagggtttcgggagagttcgcgcgtatcgttcggtttcgcggcgttagttatggcgttcgtgcgtggtttcgttagggatggggcgacgcggttagagtcgtacgcgatcgaaattcgtatt

SEQ ID NO: 10569 - DNA, 201 bp, Artificial Sequence
  Description of Artificial Sequence: Synthetic polynucleotide
gttagaaaggatcgagaaaaattttaaagttttaagtttgagttagggagggttttagagggaggtttgattgtagatcgggagtttttttttttcgtgcgtcgttgttcgggacgagaaattcgtggggtatttaggattaggatacgaggttttagtttgggtaggtggataagttgtggggttttatttttcgtaggc

SEQ ID NO: 10570 - DNA, 201 bp, Artificial Sequence
  Description of Artificial Sequence: Synthetic polynucleotide
gtcgttgagtacgcgttttaggtaggttttgggaagttcgggatggaagtagttttttttttttcgtttttttttttttttttttttttttttttttttcgcgtttttttttttttttttgttttttttggacgtgggttgtcggttgtagttcggagggacggggcgcgggacggagtttttcgcgggaggaggggtcgg

SEQ ID NO: 10571 - DNA, 203 bp, Artificial Sequence
  Description of Artificial Sequence: Synthetic polynucleotide
gtaggagcggttcgtgttcgcgggcgggagcgtgcggtttggattgtttcgtcggataggtattgttttttcgttttttcgggttcgaggcgggtcgcgcgcgtcggtcgtcgttcgggcgtttcgcggtgggcgagatgcgtcgcgttcgttttatgtttgtcgttcgcgcgttttttgttttttatttcgtagtcgttcgt

SEQ ID NO: 10572 - DNA, 201 bp, Artificial Sequence
  Description of Artificial Sequence: Synthetic polynucleotide
tttttcgtagagggtaggatatttattttttcgtgtatttgtttttttttcggtttttcgtttttagtagtattttaggatttaggggtgttatcgggtcggggagggaggggttgagtttgggtttggggatatcgggatagggggaggggttggcgttttcgtttggtcgggatttcgtggtttagcgcggttttacga

SEQ ID NO: 10573 - DNA, 201 bp, Artificial Sequence
  Description of Artificial Sequence: Synthetic polynucleotide
agcgtttgtttaatttgtagtgatatcgtttagttgtttagggttttagttgttatagttaattagttcgcggtcggggaggagcgtcgggtaggggggcgggggggtatgaaggggtcggcgggggaggttgtgggggttgtaggaggggtaggcgtaggaggaggtttgtggtttttaggttcggttcgtttttttagg

SEQ ID NO: 10574 - DNA, 201 bp, Artificial Sequence
  Description of Artificial Sequence: Synthetic polynucleotide
gggcgtattgggcgaaggcgacgcgcggttcgtgggtgtagcgttgggcgttttgaggaggtttttgttgcggtttcgggcgtttgtgcggtttttgagcgcggagttgggatcgcgttttttttcgttattggacgacgtgagtaaacgtttcgttttcgggtttcgtttttgtcgttgttatcgttttcgtttttttag

SEQ ID NO: 10575 - DNA, 201 bp, Artificial Sequence
  Description of Artificial Sequence: Synthetic polynucleotide
taggtagaggggggcgggagggggtgtgagggagaggaggagtcggagtcgtcgttgcggtttttttcggggaggggagaggagaatttttttttttttcgtttttttttagtttttcgttggttcgggagggggtggggcgtcgaggtcgcggcgattcggtagggtttggtcggtgaagagtaggcgggcggggtgcgg

SEQ ID NO: 10576 - DNA, 201 bp, Artificial Sequence
  Description of Artificial Sequence: Synthetic polynucleotide
ttaattttgcgttttttttttagttcgagttttttcgttgtttttttttttttttttttcgagtttttttttttttggcgcggcgtcgttagttagtttcggcggggagagtgtaggtattttgtttttagaataattagtaggatttaagtcggtttttcgagcgcgttttttttttttttttttgtttttttttttcgg

SEQ ID NO: 10577 - DNA, 201 bp, Artificial Sequence
  Description of Artificial Sequence: Synthetic polynucleotide
cgcggacggcgttcgatagtagttggaggagcggtttgtcgatttggcggcgagttatttggaggttattcgtgcgcgggacgagtgggatcggtagaacgcgcggttgcgttaggagaacgttcggttgcggttcgagaatcggcggttgaagcgcgagaatcgtagtttttttcgttaggttttgcggtttttcggcga

SEQ ID NO: 10578 - DNA, 201 bp, Artificial Sequence
  Description of Artificial Sequence: Synthetic polynucleotide
ttcgttttttcgttttagttcgcgtatttatcgcgtacgtagagtagtgatatggtcgaggatcgggtaagtttttgtcgcgttttagtcgcgtcggatcgttttttttttttttttagtaggtgtcgcgattgttttcgttatcggttttacgggtttggtagttttttatggtttcggtcgtaggtagcgtttcgtcgt

SEQ ID NO: 10579 - DNA, 201 bp, Artificial Sequence
  Description of Artificial Sequence: Synthetic polynucleotide
tggttattgttgcgtaggcgtagttttgggagcggcgggagttggaagtttaggagttttagggggcgtagggtcgggtagaaggcggcgagttgggggcggatatttatcggggattggaagcggttcgcgtaggttggggatattcggggttagggcgggtcgtttggggtgggagagtatagtgaggaagtttgacgt

SEQ ID NO: 10580 - DNA, 201 bp, Artificial Sequence
  Description of Artificial Sequence: Synthetic polynucleotide
ttggggacgtcgtagttcggttcggggagggggcgttaggtcgggagtcgtagcgcgggagggacgagttcgggtcggcggggggaggggagcgggaagcgtttttgttgttggcgatcgggattttttttcggtataggggaaaggcggggaagttattttttatcgggtttgtgtttttgagaggattttttgatggtt

SEQ ID NO: 10581 - DNA, 201 bp, Artificial Sequence
  Description of Artificial Sequence: Synthetic polynucleotide
ggtttttgggaggcgtcgcgtgggggcgcggttcgtggagttcgggcgttagggatcggtcggggtcggcgtacgggtgcgttttgggttcgttcgggtcgtgggagttagggagttagggagttagggatttcggttttcgtacggggtagataggggtagcgcgggcgattcggagcgtttgcgttttcgcggtttttt

SEQ ID NO: 10582 - DNA, 523 bp, Artificial Sequence
  Description of Artificial Sequence: Synthetic polynucleotide
agagtatcgggttttttattgttttagagcgcgtgtgcggttttgggcgcgtatagtgacggtgacggtatttttggttcggtagcgtcgaggtcgtttcgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcgtggtttttcgggggcggtatcgttaggtgagcgtcggtcggggcgaggtcgggtttcgggcggtaggtacggggttaggtggttttgaaatttggcgtag

SEQ ID NO: 10583 - DNA, 201 bp, Artificial Sequence
  Description of Artificial Sequence: Synthetic polynucleotide
cggcggtaggcgggggagggggtgggggtgtaggggcggtttcgcgggtcgcggggggggcgcgcggcgtagcggggtttcgggcggggcgtagcgggtcgcggggtttcgggcgcgtttttcgcgttattttagtgttatggtgcgttcgttgagtcgtcgggtttagagttggggttggcggcggagggatacgggtcg

SEQ ID NO: 10584 - DNA, 201 bp, Artificial Sequence
  Description of Artificial Sequence: Synthetic polynucleotide
cgttttttcgttttttcggtatttgtttattttcgtaattgtttcggtttttaatatttgtatcgtttaatttttttttttttcgttttttgtttttttcgtatttgttcggagttttagtatttgtttcgtttttcgttatttttttttttgttggtttgatggggtgtgggtttaagggagttatatttgggcggaggt

SEQ ID NO: 10585 - DNA, 201 bp, Artificial Sequence
  Description of Artificial Sequence: Synthetic polynucleotide
tttcggtttgacggaatataggcgacgtacgtgaagtttaggttttattttagcgtaggcgggtttttagcgatttatagttgttatatattcggttagcgtcgattttcgaaggcgtattttttatattttatttcgagtatcggttttatcgttagggaaggtttttttggatagtaaggtcggggtttaggatttgcg

SEQ ID NO: 10586 - DNA, 201 bp, Artificial Sequence
  Description of Artificial Sequence: Synthetic polynucleotide
cggtaattttttttatcgttttttgtagtaggcgtcgagtcgtcgttattttgtttttcgttttttttttttttttatcgatatttatatagcgaaaatcggttcggtcggtttgcggtttttattttacgtttgtagttttcgttttttcgttaggttttatttcggcgcggtgttttaggtcggtcgcggagtcgattc

SEQ ID NO: 10587 - DNA, 201 bp, Artificial Sequence
  Description of Artificial Sequence: Synthetic polynucleotide
cgtcggcgggcgggaggtatatacgcgcgtataagcggaaagaaagcgggtttattgcgtggggatgttcgttcgcgtagttgtttcggcggcggcggtcgttgtttgtatcgaggtcgaggcgcggcggtggcggcggcggttgcggattgagtttttttcgtcgggcggtggatgtagggcgcgggaggggcgcgaggg

SEQ ID NO: 10588 - DNA, 201 bp, Artificial Sequence
  Description of Artificial Sequence: Synthetic polynucleotide
tttttcgttagcgtttttcgttcgttcgttttttttcggtttcgtttcgcggggttgttggagaaattaagtttggggttttttttgtcgagtacggggcgagttttagaaggttttgtcgtgatggaaaatttttaggtaaattttttcgggttcgtggtttttaggtcgggaagttttcgttacgtgaagggttttcgt

SEQ ID NO: 10589 - DNA, 201 bp, Artificial Sequence
  Description of Artificial Sequence: Synthetic polynucleotide
tttttatatagaaaatttgtattagttatgtaagttaaaaagttgtgtgaatttaggtgtttcggaaaggggttgtaggatatagtaaaatgttagtagcgtgtcggattttttttttttatttttttttttaaagaatagaggttaggaaaaatattggttgggacgttagaagggttatgtgttaattataattatatt

SEQ ID NO: 10590 - DNA, 301 bp, Artificial Sequence
  Description of Artificial Sequence: Synthetic polynucleotide
gcggatggggttttgattagttgtggatttttgttttagcgtatttatttaatcgtgttttttttggttggtagagggcgttaaaggcgacgtgtcggtcgttagttttaggtcgagtttcgagcgtttgtaggaatacgtttttttattcggcgcgggacgtagagttgcgagagaattttgtttagcgcggatttaacgttagggcgtcgtttagaggttggtttttgtttcggttttattcgtcgggagattatagagttgtttttttagtcgttcgtcgttagaaattggaaaaaaa

SEQ ID NO: 10591 - DNA, 223 bp, Artificial Sequence
  Description of Artificial Sequence: Synthetic polynucleotide
ttagagttgtacgtagatgaatacgaagagtagcgcgtagaatacggtgtagacgacggtgaggttaagttttacgtaggggggtacggtcggggttagcgtgggcggtagcgagtcgttgcgggttgggttttacggcggggtttttatcgggtcgggggcgttgtcgcgcggtcggggacgttcgggttttatcggggtttacggtcgtcgtcgttttcgc

SEQ ID NO: 10592 - DNA, 720 bp, Artificial Sequence
  Description of Artificial Sequence: Synthetic polynucleotide
tagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgtt

SEQ ID NO: 10593 - DNA, 1683 bp, Artificial Sequence
  Description of Artificial Sequence: Synthetic polynucleotide
atcgagggagggtgtaaaaggcggggggcggagggggggtagattagattaggcgaaatttaataagtttttagttttttagtttaaagtttttattatcgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcggtttagtggtttttgcgcgtcggagttcgtcgcgaagattgagcggtcgcggggatcgtcgcgggtttcgcgcgtatttttgggtttaatattgttatta

SEQ ID NO: 10594 - DNA, 233 bp, Artificial Sequence
  Description of Artificial Sequence: Synthetic polynucleotide
aaataaaaagattaaaggagtagcggtcggggcggtagcggtttttaggtcgggatattcggggtggtgcgttcgggtttgcgggggttgcgtcggcgtcggggaggcggggggagcgggagcgggcgacgcggggaaggggggagttagggggagggcgtcggtcggaggaggggcggattcgttcgttttagtcgagtagagtatagtcgagtcgagcggttcgggcgggg

SEQ ID NO: 10595 - DNA, 213 bp, Artificial Sequence
  Description of Artificial Sequence: Synthetic polynucleotide
tttttttttaaagtaaatagtatttttttattattttgtagttgggttttttttattggttttcgttttttcggtggagacggcgacgtggtttatacgcgagtttttcgtcgaggatgaattattagttagttcgagttgttatattttattttagtatagttatcgcgagagtttcggggtcgcgtcggcgtgttttacgtacgcgtagtt

SEQ ID NO: 10596 - DNA, 236 bp, Artificial Sequence
  Description of Artificial Sequence: Synthetic polynucleotide
cgcgttgagttttattttgcggcggtcggacgtttcggcgtagggggcggcgcggcgggcgcggtgttgggtatcgataacgtgtgcgagttggcggcgcggttgttttttagtatcgtggagtgggcgcgttacgcgtttttttttttcgagttgtcggtggtcgattaggtggcgttgttgcgtttgagttggagcgagtttttcgtgttgaacgcggcgtaggcggcgttgtt

SEQ ID NO: 10597 - DNA, 233 bp, Artificial Sequence
  Description of Artificial Sequence: Synthetic polynucleotide
ttagttgtggatttttaatatttgtaggttataggattagaggttgggtttttaggagtagaggatatagagtagtgaagacgagattcggagttttagcggtagttaaagataaagaagcggataaatttcgttatatttcggaagtcgtttttttcgtttaagttgcgtgtttgattggatagtttttagtttagcgtcgttgattggataacgtttaaaattttattttt

SEQ ID NO: 10598 - DNA, 737 bp, Artificial Sequence
  Description of Artificial Sequence: Synthetic polynucleotide
ttcgttcgatttaggtttcgagtttttttttcgattttttttagtttaaaggttgtattcgttttaggtttttttagttcggttttttagtttttttttcggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcgttgtcgggcgaggtcggtttacgtggagtcgggagtttgaggtttttgtacgcgggagttgcggacgatggtggttagtgttattgtttacgacgttatt

SEQ ID NO: 10599 - DNA, 308 bp, Artificial Sequence
  Description of Artificial Sequence: Synthetic polynucleotide
atagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtgga

SEQ ID NO: 10600 - DNA, 1100 bp, Artificial Sequence
  Description of Artificial Sequence: Synthetic polynucleotide
tgatgcgtttggtgattttttttgggtttttgtttaagcggagttataggttgtgggggcggttaggtttttggggaagagtaggtgtcgcggtgtcggcgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcgtttcgcgatttgttcggttgttcgcgttgtcggcggttgttgtataagtcggtgacgttgttttgcgggtttatagtttgtaagcgttgcgtggagttag

SEQ ID NO: 10601 - DNA, 214 bp, Artificial Sequence
  Description of Artificial Sequence: Synthetic polynucleotide
gaagaaataatatattgtagattgtaacgagtacggggagttagcgaaaggtagggcgtttattagggcgcgttgagagatcgggaattttcgtaagggcgttcgcgtcgttcgttattcgtcgtcgcgcgtacgtcgcgttttcgtttatttttaaataatatttatagttagggtttttttttttttttttttttttttttttgttttcgtt

SEQ ID NO: 10602 - DNA, 582 bp, Artificial Sequence
  Description of Artificial Sequence: Synthetic polynucleotide
agtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagag

SEQ ID NO: 10603 - DNA, 203 bp, Artificial Sequence
  Description of Artificial Sequence: Synthetic polynucleotide
tttttaggaggcgttttgatttcgtatttcggttttttatttttcgatcgttagttttagggtcgtcgcggcgacgcgcgattttttttttttgaggggcgcgggtttcggacgcgtcgggttttgttaggtatttagtggagggtcggaggtcggcgattagttcgagtttagtcgtttcgggagttggcgcgagtgtcgtt

SEQ ID NO: 10604 - DNA, 823 bp, Artificial Sequence
  Description of Artificial Sequence: Synthetic polynucleotide
taattatttgttttagatcgcgttatttgtaatttgtttcgggttggcgttatattcggcgtttcggcgttttttataagtgttttcgtttatgattagcgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcgttggttgcgggttttgggggttttttgtttttttcgggtttcgttttttcgtatttttttggtttgattatgatttttgaaggagaatacggataattcg

SEQ ID NO: 10605 - DNA, 293 bp, Artificial Sequence
  Description of Artificial Sequence: Synthetic polynucleotide
ttttgtttttaagggagagggatagtattttttcgggtttttagtttttttgggtgtggcgggagagttttgggcgaggttgcgtttatatttgtatttcggtcggttttttcggttgatttcgttttggttgatttcgcgtatattttttttttagcgttgtaaggatcgtttgaattcgttggttatttcggtgatgaattagtggttcggtgtgaagttgcgggtgatcgagggttgggacgaggacggttattatttagaggagtttttgtattatgagggtcgcgcgg

SEQ ID NO: 10606 - DNA, 262 bp, Artificial Sequence
  Description of Artificial Sequence: Synthetic polynucleotide
gcggggtatgttggcgcggttcgagggtacggtattggttcggtttttttttcgcgttcggtttcggcggtttttagtgttttcggtttattgttcgggcgcggcggttgcgggattcgcgtggcgtcggcgacggttcggtttagttttgcgttttgtacgcgcgtttttgttttcgggttcggtagtcgtttttttttaacggggggagggggttattgttttcgtttttcgttttttttggagttaattagcgcgttcg

SEQ ID NO: 10607 - DNA, 240 bp, Artificial Sequence
  Description of Artificial Sequence: Synthetic polynucleotide
gttttttttttattgttttttcgttattagtcgtttttgtcgtcgagttcgtagtcgttagcgcgtttcgagtttttttaggttagaggttttcgtaggcgatggcggataagagggcggggattttagaagtcgcggcgcgttcgtcgttcggttttgttcgggagggggacgcgcgtacggttttcgcggttcgggttcgagaagttggggggcgcgggtttttttatttcgtagcgg

SEQ ID NO: 10608 - DNA, 1240 bp, Artificial Sequence
  Description of Artificial Sequence: Synthetic polynucleotide
ggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgtt

SEQ ID NO: 10609 - DNA, 222 bp, Artificial Sequence
  Description of Artificial Sequence: Synthetic polynucleotide
aataaaaatttatattatatagcgatggtggtgtttggtggcggtggcggggtggggggtttgattagatgagtcgtttttcgcgttttcggcgtcgggcgttatggttcgagtcgaaggcgtttttggtttcggagcgttcgcggtttttgcgtttggcgcggtcgtttaagtaggagaagaaggcgtagtttaggaatattcggaagtagtaggtcgttt

SEQ ID NO: 10610 - DNA, 714 bp, Artificial Sequence
  Description of Artificial Sequence: Synthetic polynucleotide
tgtgattttttttttttgttttaagtggttggcgatatagttttcggcgcgtcgggtattgaggttttggagtatagcgtggggggtttggtatagatacgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcggttgttttttggagtatttttgttatagtatttttattttgggttagggtattttgttgcggattttgagttttaggaaggaggtttataatagcggaaagttatttttttttaagaattgttgagtttttcggattgtatttttaaagattttttttgaa

SEQ ID NO: 10611 - DNA, 1216 bp, Artificial Sequence
  Description of Artificial Sequence: Synthetic polynucleotide
tttattttgaggttttttagatttcgtagggttttttacgttattaagtttgtttcgattttttttcgttgttttttatattttttgtcgcggcgcggtcggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcgggtcggtgtttttgtcgcgggaaggaggattcggacgtttaatttagcggcgaagtcgttttttattggaggaggtttttcgaaaacgtttttgaaattt

SEQ ID NO: 10612 - DNA, 207 bp, Artificial Sequence
  Description of Artificial Sequence: Synthetic polynucleotide
ggtttgtttagtttttatttcggtatcgaagtcgtagttttcgggtttattttcgtatttttaggggttttcgggggttgtcgataggtttttgattagcgagcgcgttttcggggtaagtatttttggcgggtagaaatttgggagcggagtatagcggtgtaagggaatcgtgttaggcgggaagggcggaatttgcggggaatt

SEQ ID NO: 10613 - DNA, 253 bp, Artificial Sequence
  Description of Artificial Sequence: Synthetic polynucleotide
ggttgcgtagcgtttttaatttaatttttggatttattttcgttttagtttttttcgtgtttagcgttttttgtaaatgattttttcggtcgggtgtttcgttttttttttcggtttttttcgcgtggtttgtttttcgttcgtttgcgttcgttcggtttttttgtttttgcgtttttatttgatcgtaaaggcggttagggtagttttcgcgcggtttgatagttacggtttttagtttgtttttggacgt

SEQ ID NO: 10614 - DNA, 209 bp, Artificial Sequence
  Description of Artificial Sequence: Synthetic polynucleotide
ggttaggtttgagttttatttatttacgtcgtattttttttttttcgtgggggtttatatggtcgtgtcgggcgcggtttcgcgggcgcggcgatcgggcgataacgcggcggggacggtcgcgggttcggttgtggcgtatcgcgagtcgaggcggggacggttaggcggcgcggggtagtgggcggcgtattttttataggtcgttc

SEQ ID NO: 10615 - DNA, 225 bp, Artificial Sequence
  Description of Artificial Sequence: Synthetic polynucleotide
ttgcgatcggtttttaatttgggtcgagttgcgtagcggggcgggcgcgcggggcggggcgggtcgcgggttttggggagttggtcgggaatcggagttcgcggtcgtttggtcgaatttgttcgcgcggcgtcggggaggagttcggggcggcggcgcggggcgcgcgttcggcgagggcgttttttttagggtcgtttgtagtttgcgggacggggtcgagcg

SEQ ID NO: 10616 - DNA, 1133 bp, Artificial Sequence
  Description of Artificial Sequence: Synthetic polynucleotide
ggaggagaagcgacgtaagtgggtagttttttagcgtcggcgaggcgcgggaggaggagaagtagtggggaggcgtagtcgtttatttgcggggtagggcgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcgggcgtcgcggtagttgtttcggttgtcggtcggcggtttcgcgttcgttcgtttcgttttcgttcgttgttttgttgtacgaatttttttaatttttttt

SEQ ID NO: 10617 - DNA, 478 bp, Artificial Sequence
  Description of Artificial Sequence: Synthetic polynucleotide
tgaattgagggggttcggcggtcgttgaggaggggagcgcgcgggaggaggggcgaggagttcggaggcgggcgcggttggtagtttagagggttcgggcggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcgattttggttttttcgtaagtttttcggattcgggcgttttcggtttttttttatttatttttttgtcgggtaggttcgcgatttttcgtttttcgggtcg

SEQ ID NO: 10618 - DNA, 201 bp, Artificial Sequence
  Description of Artificial Sequence: Synthetic polynucleotide
ttaatgtgttttaatacgttttaatgtgttgtgataggaaaagagtcggttaacggtattacggaagtattagttggtatagaggttcggtgtaattatcgttttgtatcgtaaaacgggtttaggaagtttttaggagatattagcggtgttagaatcgagaaagtgacgatatagataatttatggatttcgcgtacgg

SEQ ID NO: 10619 - DNA, 208 bp, Artificial Sequence
  Description of Artificial Sequence: Synthetic polynucleotide
gttttcgtcgtcgttcgggtcgcgttcgtttcgtttttaggcgtcggtttcggagttcggttcgcgagtagcggcggttgtcggagggacgatgagttgcgcggggcgggcgggttttgttcggttcgtcgcgttcgttttgttgatttgtagtttgtggtcggtacgggtagataacgcgagttaggagtattatacggcgtttatt

SEQ ID NO: 10620 - DNA, 210 bp, Artificial Sequence
  Description of Artificial Sequence: Synthetic polynucleotide
ttagtttttcgggaagtagtaggcgtacggtcgtttggatttttttggaggtgatggtcgagcgtttgttgtaatgcgttaggcgggaagtttcgtcggcgatgcgttcgaagatgtcgttgataaaggaatttatgatttttatggttttagaggagatgtcggtgtcggggtggatttgttttagtattttgtatacgtatacggagt

SEQ ID NO: 10621 - DNA, 229 bp, Artificial Sequence
  Description of Artificial Sequence: Synthetic polynucleotide
ttttaagatagggtttttttttcgttcgggttggagtgcggtggtacgattttcggtcgttgtaacgttcgtttttgggtttaagtgatttttttgtttcggttttttgagtagttgagattataagcgttagttattatagttcggttaatttttgtattttttagtagagatagggttttattatattggttattttggttttaaatttttgagtttaggtgagtta

SEQ ID NO: 10622 - DNA, 209 bp, Artificial Sequence
  Description of Artificial Sequence: Synthetic polynucleotide
tttttttttttttttaatatttttttttagaaaaagaggaacgtaacgaagggagtttagttattatgttggagttgtggatcggttttgtgaggtttacgcgggagcgcggaggtttttgggttttagggcgtcggtagatggtttgtagcgtatcgttcggttttcgcgttggttacgttcgttagcgttatttttttttttcgttt

SEQ ID NO: 10623 - DNA, 255 bp, Artificial Sequence
  Description of Artificial Sequence: Synthetic polynucleotide
gttatttcgtagcgagttaaagttattttttattttgggttcgttacgcgatttttgtcggttttcgttttacgcggttttagtacggcgttaaggtttcgtttataaatcggtttcgttttttcgtgttcgggttcgtcgtttattagacgtcgtttcggcgtagcgagttgagggtacgtttatttttttttcgggtttttagtttttaaggttttagtataatgttttaggaggaagattttaggttttttt

SEQ ID NO: 10624 - DNA, 297 bp, Artificial Sequence
  Description of Artificial Sequence: Synthetic polynucleotide
tttattattgttaacgtcgtcgtcgcgttttttttattttatttttttttttttaggagaatttttagtttcggtttttttcgtttcggcgtttcgttacgtgatttcgggtcgttttttatacgtgatcgtttttttttttttttttattttcgtattcgttttttttttagttttttgtttcgttttgttggtcgttaggtatttcggggagaggtcgtttggaggcggggttttaggttttatttttcggagggtggagaggggcgggtaaattacgtcgagtgggcggggttt

SEQ ID NO: 10625 - DNA, 232 bp, Artificial Sequence
  Description of Artificial Sequence: Synthetic polynucleotide
tagtcgttttaagtttttttttttttttttttttttttttttgtttcggaaagttagcgagttttcggtagcggtcgtattttcgtttcggtggtttgacgacggcggcggtcgtttttgcgcgttttttcgttttttttcggtttagtttagacgtcgtagtggcggtaattgcggtagcggtggcggttttgatttcgcgtatttcgttttttttttttagttagtttat

SEQ ID NO: 10626 - DNA, 247 bp, Artificial Sequence
  Description of Artificial Sequence: Synthetic polynucleotide
tttttcgcggttttttttttttcgcgtttttttttttatatcgggttttcggggtagtagcggggaggggagatcggcgggggagggaggatagggaggcgaaggaattggggtggggggtgcgtgtgtggtggagggggtgggacgatataggtgttttgaggggaggagtcgggaggaaggcgaggaggtcgggttaagtgggggtgcggaggtcggggagataggaacgcggttgcgggcgcgg

SEQ ID NO: 10627 - DNA, 292 bp, Artificial Sequence
  Description of Artificial Sequence: Synthetic polynucleotide
gggcgttgaggttgaagttggggtcgggggtgggattgggggcgttggggttgggtcgggggtgggattgaggttgcgggcgtttaattgggattgagtcgagggtagcggtggggttgggtcgggggagtaggggtcgcgtcgggtagcgtcgcgtgttggagcggaggcgggtgcggtcggggtaggtcgcgggaggaggaagcgtttggggagtaggagttgggtcgggcgggttcgcgtttcgtattcgcgggggtgaatcggagtcgtcgtagggggttcggggggt

SEQ ID NO: 10628 - DNA, 201 bp, Artificial Sequence
  Description of Artificial Sequence: Synthetic polynucleotide
tgttgtggggtttagggttgtatggggtagtaaggcgcgggggttcgggtcgtagagttttcggggaggattcggaggggaggtagtggttcggcggttcgggttatagttcggtgtggtgggggggagggagacggggcgggagagggggtaaggttgtttttgaagggaattagttggttcgttcgttggtcgagttgt

SEQ ID NO: 10629 - DNA, 201 bp, Artificial Sequence
  Description of Artificial Sequence: Synthetic polynucleotide
atttttgttttttatatttattttttattttcgttttagaaatacgttttttatatcgggttcgtcggatttttatattttttattcgcgttagaaacgcgcgtattttcgtggtttttttttgtcgcgcgtaaatacgttcggttcgcgtacgttttttcggtttggtttcgtatattcgcgttagaaatacgcgtggtc

SEQ ID NO: 10630 - DNA, 201 bp, Artificial Sequence
  Description of Artificial Sequence: Synthetic polynucleotide
cgacgttcgagttagcggagttcggagtcgttgggtttttcgtttttttcgttcgttcgtttttttcgttttttcggtttttttcgtttcgtcgttttgcgtcgttttattataaaaggtgaggttcggggggagggggcgcgggattttcgtttcgcggaagcggtttttatttgttttttaatttgttcggtcgcgttt

SEQ ID NO: 10631 - DNA, 201 bp, Artificial Sequence
  Description of Artificial Sequence: Synthetic polynucleotide
gttttattaagcggttttagttataacggcgtgtatgttaattacgtttgtaggttatcgttcgttttcggttgtcggattatttagcgcgttttttttcgagtttcggacggggagaggaggagttaggggaggaggcgggaggaagggaaggatggggaggataatgggggaagaagagggaggatggaggaagggggt

SEQ ID NO: 10632 - DNA, 201 bp, Artificial Sequence
  Description of Artificial Sequence: Synthetic polynucleotide
tattatttcgttgtcggcggcgtttttttgggaagtagtagtaattggtggagttggagtcgtagtagtttgagtcgtcgtagtagtttttgtcggagtcgtagtaggaggaggaggaggcgggcgtcggggtgggcgtcggggcgggatacggagcggggttttgggacgattttttggaaaagtttttggcggaaacgg

SEQ ID NO: 10633 - DNA, 201 bp, Artificial Sequence
  Description of Artificial Sequence: Synthetic polynucleotide
gggcggggtcggaggaaaaggggcggggcggcggggaaaatataaattaaaatttaaaaattagttaaaggaaggatggaagtttcgcggttttttcggcgtttagcggtgtttttgttttggtgttcggattttagttcgcggtttgtttgtttgttagtttcgtggatatcgtattgtcgggtagcgtttcggtcgtat

SEQ ID NO: 10634 - DNA, 201 bp, Artificial Sequence
  Description of Artificial Sequence: Synthetic polynucleotide
tagtatgatgtcgtttttttggtagtggtagggggtcgggtaggcggtgggtttcgggtcgggttggggggcgtcgtcggtttttcgggaagcgtatagcgcggcgtaaagttatagcgttcggagtttcggcgggttgggtatttcggcggtcgggttattggggtatttggcggtcgggcgcggacgtacggcgcgatg

SEQ ID NO: 10635 - DNA, 241 bp, Artificial Sequence
  Description of Artificial Sequence: Synthetic polynucleotide
cgaagaaaggggcgcgggggcgcgggggcgcgggggcgcgtggggcgttgggcgtcggaggtttggtaggatgcgcggtggggtcgtcgtcgtcgtcgtcgttgcgcgttcgttttttggtcgggcgcgcgtttcgtttcgtagtatttatagggcgtcgcggtttcgtttttttataggtttcgtttcggttagtttacgtttcgttttcggtttcgttttttgtcgttagggcgcgtag

SEQ ID NO: 10636 - DNA, 201 bp, Artificial Sequence
  Description of Artificial Sequence: Synthetic polynucleotide
gtcgttgtcgttttgtcgttcggtgtgcgagcgcgttaaggtcggttgcgcgtcgtttatgcgttagtacggtttcgtttggttcgatcgtatgcgttgcgatcggttgttcgagtaaggtaattttgatacgttgtgtatggattataatcgtatcgatttaattatcgtcgcgtttagttcgtcgcgtcgtttgtcgtc

SEQ ID NO: 10637 - DNA, 201 bp, Artificial Sequence
  Description of Artificial Sequence: Synthetic polynucleotide
agaggaagtgagaggtgtttaattcggttatgtagaacgtagttgggttgttcgaaacgaaataaagcggttatttcgaaggaggtgttgtttttgggtcggtttaggttgagttagagtagacgttatttttacgttaaaaatattaggttattgttttagggagttgggttatttattgaggttatttttattttattt

SEQ ID NO: 10638 - DNA, 201 bp, Artificial Sequence
  Description of Artificial Sequence: Synthetic polynucleotide
gtatttatttttttgacggtttcgtttcgtagggagggtttgtgtcggttgttggagtttattcgtagatttatttttattattttcgagggttagaggcgcgatttcgcgtattcggcgtttcgtttgttgcgttagtatcgttatttggtgattttgttgttttggaggttcggtttcgtggtgcggagtaggcgcggg

SEQ ID NO: 10639 - DNA, 201 bp, Artificial Sequence
  Description of Artificial Sequence: Synthetic polynucleotide
ggtttttggagttattggtttagggcgggttcgcgggatggggcgggcggttcggggcgtagtcggttaggtcgttgttatggtaacgcggtggaaaaacgggtttttgggtatttcgttgtcggtcggttggtaattttttagcggagggatcgggtcgagttcgcggattttttcgagtgttttttggggtttagtcgt

SEQ ID NO: 10640 - DNA, 201 bp, Artificial Sequence
  Description of Artificial Sequence: Synthetic polynucleotide
ttaaaagtagtttttttgaattttatttgggttttgtagggttttttcgaggttcgagaattgggagaagggaaagagtttatcggtttgtttgaaggtcggcgggcggtgtaggtagttttttttagatttttttagtttcggttttttacgtatattagaagagtcgttttttttttttagtgattgaaattatttgga

SEQ ID NO: 10641 - DNA, 201 bp, Artificial Sequence
  Description of Artificial Sequence: Synthetic polynucleotide
ggttttgttttagggttttgtattttcgagagttgttgtatgtcggggattggtttttaagtttgtttgagtttttttagtttttcgggtatcgttatgcggtgggagggtgagttttttttttttgttgaaatttcggcggtttggtaatcggtcggggggttttggatttttcggggagatattattgatgttttgtgg

SEQ ID NO: 10642 - DNA, 201 bp, Artificial Sequence
  Description of Artificial Sequence: Synthetic polynucleotide
gtgtttttcgttgatttttagaggagatattggttagggttttttttttcgagataaattttattttggaaaggttgttagatcgggcgcggtgatttacgtttgtaattttagtattttgggaggatgaggtgggcggattgtttgagtttaggagttcgaaattattttgggtaatatgttgaaatttcgtttttatta

SEQ ID NO: 10643 - DNA, 201 bp, Artificial Sequence
  Description of Artificial Sequence: Synthetic polynucleotide
gtatatttcggtcgggtgcgggtcggcggggtatagcggtttttacggttcgttttcgttagttatttttcggttttttttttcgttgttcgcgtgtttcgggtcggtttagtatttttcgagttacgtgttcgcgtttttcggcggggaggagcgtagtcgcgggggcgcgtttcggtgatttcgttttttagttttttt

SEQ ID NO: 10644 - DNA, 201 bp, Artificial Sequence
  Description of Artificial Sequence: Synthetic polynucleotide
ttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggatt

SEQ ID NO: 10645 - DNA, 201 bp, Artificial Sequence
  Description of Artificial Sequence: Synthetic polynucleotide
ggggcggagcggggaggggcggggcggagcggggaggggcggggcggagaaggatcgtagggttgagcggggcgttagcgttagtgttcggtattgtttcgggttgggttttttgcgttagaggaaggggagttcggggacggggtacggggttcgcgaggtacgggtgttttttcggggtttcggaagttttttttttcg

SEQ ID NO: 10646 - DNA, 239 bp, Artificial Sequence
  Description of Artificial Sequence: Synthetic polynucleotide
gagaggaagggggaaggagatagaggaatcgagattggggtgagggagcggtcgcgcgtggttttcggagaggcgtttattatttgcgtggcgttttttcgcgtcggagtgcggttttgtttttagcgttagtgcgtcgcgcggttcgtcggtttcgtaggattggttatcgttttttatttatgtaatttgcgtgtgcgtgtgcgtgtgtgtgtgtgtttttttttcgttcgtttttt

SEQ ID NO: 10647 - DNA, 201 bp, Artificial Sequence
  Description of Artificial Sequence: Synthetic polynucleotide
ttttttcgtgggtggttttcgtgagttttttggttagtttttttattttagttttataatggtttatcgtttgtaatattttttttgcggttatagtttcggtggatggaggtaggagggggttacggggtgggggagatggatgcgaagttggcggggaaagggagaaggaaatgggaagggatgggtggaaacggaaaa

SEQ ID NO: 10648 - DNA, 201 bp, Artificial Sequence
  Description of Artificial Sequence: Synthetic polynucleotide
ttatttgaaattgataggtttgttttttatgataatagttgttattaattagttttttttatatttttttatttatcggttttagtattttgtatatttcgcggagaattcgtttttggttttttatagagtatagtattagggtgtagattattatatttatagagttattagttatttggtgtatgtttttttcggtag

SEQ ID NO: 10649 - DNA, 201 bp, Artificial Sequence
  Description of Artificial Sequence: Synthetic polynucleotide
aaaatagtagttttatggaaaataatagaaaaaaattttattttagtttggtaattaacggttggtcgggggacgtgttcgcgttgtttttttttcggtcgttagggggcgtaggaagaagttttggaggtttgtttcgggatcgcgtattcgtttttttttttcgttagttttttttttattttcgttgagtttcgtttc

SEQ ID NO: 10650 - DNA, 201 bp, Artificial Sequence
  Description of Artificial Sequence: Synthetic polynucleotide
gtttgacgaagttttttttgggggtcgatgttttttttcgggtgggaaggggcgttgtcggtgagggttattttggcgtcggtttgcgtcgttcgaagtcgggggggaggggaggttttcgtttagtaggggttacgttcgtttcggacgggggtcgcgcgggcgtttaggcgacgtattttcgtcggggttcgtgatcgt

SEQ ID NO: 10651 - DNA, 201 bp, Artificial Sequence
  Description of Artificial Sequence: Synthetic polynucleotide
ttttgagaagtaatagatttcgattaatgtgtatcgttttcgcggcgtttcgtcgcgttcggaatcgttgtttatttggcgttcggtaaggaaggttgtcggagggtttataggtgtttttttcgttttcggagaagttcggtgtgggcggcgttattttagaaacgttatcggcgcgtttgtttcgagcggcgggggcga

SEQ ID NO: 10652 - DNA, 201 bp, Artificial Sequence
  Description of Artificial Sequence: Synthetic polynucleotide
tttgttatttgtatttaagatggatttttcgttgtcgtcgttgttttttcggtttttttgttattattttttacgttttgtagttttgttttttgtttacgggttgttaagtcgcggtttggtcggtggtggtagtggcggagttagataaagttttcgtttttttcgttttagagttttttaggcgttttaagtggcggg

SEQ ID NO: 10653 - DNA, 201 bp, Artificial Sequence
  Description of Artificial Sequence: Synthetic polynucleotide
ttttagggcggtcgtttttattttcggtttttatttagcggggatttattagggcgagggttgaagatttcgcgggacgtcgcgcgtcggggatagcgacgtatttatttttttagttatttgggaggttgtaggttcgggtcggagttcgaggtttaggggcgcgcggagtagttttggttaaggcgtagggcgcggggt

SEQ ID NO: 10654 - DNA, 201 bp, Artificial Sequence
  Description of Artificial Sequence: Synthetic polynucleotide
ttttggggtcgggcggggcggggcggggtaggggggtcgggcgcggtttacgcgttttttcgagtgcgcggtgcgggacgggcgcggttgacgcgttttcgtcggtgtttgtgttttttcgtaggttaggagggtattttgcgttgttattcggatttggcgggtagcgagttgtagcggggtacgtttacggtcgagtcg

SEQ ID NO: 10655 - DNA, 201 bp, Artificial Sequence
  Description of Artificial Sequence: Synthetic polynucleotide
cgggtttggataggttagtttgagagtatgcgaagtcggttttcgggtagataataagagatatcgtcgggaagtgttaggaatttcgcgcgttgttcgcggggtttttttgtagtcggggttgggttagaaggatggtaaagttgcgcggcgtcgttcgggttggagtcgtagtcgaggagtcgaagtttttttaggtcg

SEQ ID NO: 10656 - DNA, 201 bp, Artificial Sequence
  Description of Artificial Sequence: Synthetic polynucleotide
gattcggagttacgcggggcgggggtcggtatcgagggtcgggaggcgcgaagggtacgcggcggcgggaagcggggcgattcgaaggtttacgggggtcgggaggttgcggggcgttcgggattttttttcgggtggttatcgtgcggtcggggcgcggaagttagaggtgtttagaggcgtcgatttcgtcgaggttgc

SEQ ID NO: 10657 - DNA, 201 bp, Artificial Sequence
  Description of Artificial Sequence: Synthetic polynucleotide
tagtcgaggtagaaattcgtttcgaggcgcgggcgtcgggttcgggttttaaggatgcgcgtcgggttttttttcgcggggatagtcgagtttcgtcggcgttttaggtgttttcgtagtgcgttcgggcgcggacgtttttttgttttcggaggggaagcgggagggtttttggggtaacgtttcgatttcgggtttttt

SEQ ID NO: 10658 - DNA, 201 bp, Artificial Sequence
  Description of Artificial Sequence: Synthetic polynucleotide
tataggtgttttcgtcgtaggtttcgtatatttatttatggtatttatataggggttcgaagaatatgttcggtttagttacgtggtagatgtagacgtcgtagtcgtagcggtttcggtcgtggtatagcgcggttttcgggggttgtttaggtgcgcggtagcgtcgtttcgattcggttcgggatagtttgtaggcgg

SEQ ID NO: 10659 - DNA, 201 bp, Artificial Sequence
  Description of Artificial Sequence: Synthetic polynucleotide
agatcgttgtttggttattttacgtttttgagttttttatatagttagtttcgtgattttcgagtttcgtgattttcgagtttcgtgatttttaagtttcggaagtcgttgtaggtagcggtttagttaggtttcgttttttttatcggagttttacgcgttaattttagttaggtttcgttttcggtcgttttaggcgtg

SEQ ID NO: 10660 - DNA, 201 bp, Artificial Sequence
  Description of Artificial Sequence: Synthetic polynucleotide
gtagtagtttatcgaggacggggattcgtaagtggcggaggttcggggttgggggtcgtcgggagggcgggacgcgcgcggtttgggggtgggaggcgtcgggtttggagttcgagtcgggggattagcgatgtagtcgggcgggcgtcgcggtatttcggggtttttgtatcgtttcgaacgttgtagggttgtagggtc

SEQ ID NO: 10661 - DNA, 201 bp, Artificial Sequence
  Description of Artificial Sequence: Synthetic polynucleotide
attttgtaggtcgtatttttaattcgtattttatttaggttttcgtttggcgtcgatttgttttagtttaattttcggtttcgtagattaggtatttttcgggacgcggggtagattttgcgttcgggttttttttcgtagtcgggttgttcggtttttgcgcgcgtataataggcggtacggcgtagttttcgggagcgc

SEQ ID NO: 10662 - DNA, 201 bp, Artificial Sequence
  Description of Artificial Sequence: Synthetic polynucleotide
aggatggcgatggtattggcgcggattttttttatggtgggtagacgggcgttttaggtgggggattgggtcggcgtgttttcggggtcggggcgggggcgttcgtagttttagttgtttgttttcgttcgcgtttagttgtttagttttgtagagtagaaaaaggagagaggtgggggggcgggggggtgatagggagag

SEQ ID NO: 10663 - DNA, 201 bp, Artificial Sequence
  Description of Artificial Sequence: Synthetic polynucleotide
ttagttttttttgagggagtttagcggtgcgggttcgtttttttttagtttagtttttttgatatcgttttttttttggggacgttgtttgcgggttcgcgcgttttcgttttcgatttttttgtaggttttttcgggggtcggggtaggatcgtatttatcgaggattcgggcgttggagttagtagtagcggtacgagt

SEQ ID NO: 10664 - DNA, 201 bp, Artificial Sequence
  Description of Artificial Sequence: Synthetic polynucleotide
taagtcgaagtttttgaaggaggttcggtgttatttcggtgtgatcgcgtttcggcgacgttgggtagggtgtagggagttagttcggtcgcggtttagcgggaggggagggggtcggtttcgaattcgggcgttcgggtcgcgggtgatttattgggaacgttaggttcgcgcgtttagatcggcgggcgacgtttagcg

SEQ ID NO: 10665 - DNA, 201 bp, Artificial Sequence
  Description of Artificial Sequence: Synthetic polynucleotide
gggggttcggtttagggcgggaaatgggtggggaggggcggggtttgggttggagattggacggaggagtcgggcggagatgtaattggaggaagagggcgggacggggcggagaaggtttttcgtatcggcggagggagagggattaggagggggttgcggcgggggaggagagggggttttcggtttagagattgaggc

SEQ ID NO: 10666 - DNA, 201 bp, Artificial Sequence
  Description of Artificial Sequence: Synthetic polynucleotide
gcgatttttgttttttttttgggtcgagcggtaggcgcgttcgtatcgttttcgttttttcgtcgtagtcgttgtcgatcggttggttgggttttgcggcgtgaggatttcggcggcgtcgtagtttcgcgagttatggtttagttcggcggggaggttcggttcgggtttaagacggcggtgtagattcgcgtcgttatt

SEQ ID NO: 10667 - DNA, 201 bp, Artificial Sequence
  Description of Artificial Sequence: Synthetic polynucleotide
tttatgaatatttcggggcgcgggagttcgagcgttgtcggagggcgtttcgggggaggcggtcgttgatgtaagttcggcgggtcgttgggtttcgttcggttgcggcgggagtttcgggacgggtcggacgggtcggggtagaggaggcgaggcgagttcgcgggtggttagttataaagttcgggcggcgagatagac

SEQ ID NO: 10668 - DNA, 241 bp, Artificial Sequence
  Description of Artificial Sequence: Synthetic polynucleotide
ttttatttttatatatttatattcggtcgtttttcgtttttttattcgtttgtcgcgcgcgcgcgcgatttcgtttatatatagcgcgcgcgacgtcggcggagatcgtttcgtttttttagatcgaacgtcgttcgttcgtttgttgaggagcggcgcgcgtttcggtttcgtttttttggcgtcgcggcgcggcgggcggggggcggcggtcggaggagttgggggtcgggttagcgcg

SEQ ID NO: 10669 - DNA, 201 bp, Artificial Sequence
  Description of Artificial Sequence: Synthetic polynucleotide
ttttcgtcgttttttaggtttttagtgaggttttttagttggtcgtttattatggtttttattatgaacgttatggttttcgtcggtcggggtatcgggcgtttgttattacgcgttaggtatcgggtacgttcgcgtttattttagtattaggtttcgcggatagttttcgtcgcgggttcgcgttttacgtttggtatc

SEQ ID NO: 10670 - DNA, 201 bp, Artificial Sequence
  Description of Artificial Sequence: Synthetic polynucleotide
gattcggtatgaggagttcggtatttttgttttttagttttttggaagtttttttttggattggtcggcgtcgttttttcgatatttgggggttgaggtcggtatttcgggtttgcgtggaggggcgagcgttaaggttgcgagagtcgggtttcgatttgtaattattttttttaatttttatggagtttcgtttcgcgt

SEQ ID NO: 10671 - DNA, 201 bp, Artificial Sequence
  Description of Artificial Sequence: Synthetic polynucleotide
gcgttcggtagagagtttttagtcgtttcggatttcgcgtagtttcgtagagacgcgcgtgtcgttcgtacgggtcggtattcgggtcgttttcgtcggcgtgttaggatttcgtatagaagcgttcggacgcggacgtacgtagtcgcggttacgattttcgtcgttcgttcggttcgtgttcggttttggttagtaggg

SEQ ID NO: 10672 - DNA, 201 bp, Artificial Sequence
  Description of Artificial Sequence: Synthetic polynucleotide
ttttttcggttttttttttatttttcgttttcggggtttttttttgttgagcgggggttgtcgggatttgggattgcggggttgtttcgatttcgtagtcgttcgcggtggaagttagttcgggtttggttttgagcgcgcggttggggcggtcgttgtttatggtgttggcgcgggtggcgcgtcggtcggcggggtttg

SEQ ID NO: 10673 - DNA, 201 bp, Artificial Sequence
  Description of Artificial Sequence: Synthetic polynucleotide
tcgttcgcgtattggggttttcgaggtgtgatgttatttgttcgtagaatcggtttttttcgcgtcgtttttttcgcgtttttattttagtttttttttcgtcgttttcggggttaatatggtagcggcgtcgtcgttttattttcgtaatcgtacgattcggttggtagggtcgtcggttcggattttcgagatttatat

SEQ ID NO: 10674 - DNA, 201 bp, Artificial Sequence
  Description of Artificial Sequence: Synthetic polynucleotide
tcgcgggcgcggtttttggaacggattttttttcgagtcgcgttcgtcgggtcgtttttttttcgttcgtagatttcggttcggtttcgtcgtcgcgcgcgttttttttcgttttggttttttttttttcgttttcgggtttcggcgttttcgttcggttcgagcgcgcggtttgtttcgttcggtttattatggcgcggt

SEQ ID NO: 10675 - DNA, 201 bp, Artificial Sequence
  Description of Artificial Sequence: Synthetic polynucleotide
ggttaggttttttaggagtagttggggaatattcggcgattttggcggttgttttttggtggcgtagggagttcgcgtgtttgcgagtgcgtgtgtgtgcgaagtttttcgggtaagtgtgttagcgcgcgtttgggtgtgtgtaagggtgtgagcgtgtatacgtgggtacgggcgtgtgcgcgcgggggtgttcggttg

SEQ ID NO: 10676 - DNA, 201 bp, Artificial Sequence
  Description of Artificial Sequence: Synthetic polynucleotide
tttcgtttttattcgttttttttatcgcgtcgttttttcgttttgttttgcgggtttaggcggaattcggaacggtcgtttttttttttcgtttttcgtcgtcgttttttttttttttttttcggttttttttttagtttcgggtcggagcggggtgtcggcggcggtcggttcgggcggcggcgtttggttatgtcgtgt

SEQ ID NO: 10677 - DNA, 201 bp, Artificial Sequence
  Description of Artificial Sequence: Synthetic polynucleotide
ttaagttcgttgggcgttcgtttttgcgtatcgcgttcgtttttttcgtttgtgcgtttgggtttcggcgtacgtattgtatttgtcgttcgtttttgtcgtgtgtgtgtattgtcggggttcgttcgtttacgttcgcgcgtgcgtttttatttttatttcgtattcgcgtgtacgatttattcgtcgtcgttgtgcgcg

SEQ ID NO: 10678 - DNA, 201 bp, Artificial Sequence
  Description of Artificial Sequence: Synthetic polynucleotide
tgtcgaatgaagttgagcgttttagtggaattagggattttaggggtgagcgatcgcgaggggagagcgacgaaaagggcggtcggagttggaggggcgcggagttaaataaaaaagggcggtcggagttgtaggggcgtcgagttaaatacgttatttttagatggggggttttaggcgagttgtttagtttttttgagg

SEQ ID NO: 10679 - DNA, 848 bp, Homo sapiens
acggggtcgcactcgagccggcggagcatccctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtgagtccgctgcgggccggcgccgcagggctggagcccggggtgagggtggggatcacgaacttgagaccccaagcccgttccctggactccccgcgcctccgcatttcctgcaggggcacctggggcccagcgagaggcgaggccacttacatcgaggggaacacaggaatgtgtgtcatcgtgtgtatgtgtgtgtgtggtgcgggggggggagtgcgccgcg

SEQ ID NO: 10680 - DNA, 1230 bp, Homo sapiens
acgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacacccttccgaggggactccccgattcctgggctgggggcctgccgcctggccccacgtctgacgtacggggcgcgagggccactgctccctggacttctgtcggaaccggacgcagtgggaggggtcgcagggcgcccgcggggcaggaaggatgcgggccgcg

SEQ ID NO: 10681 - DNA, 1094 bp, Homo sapiens
gcggcgctaaaaatagctggggggagggtgcgggggcggcggagtctgtaacctaagccgccccagcctccggggggcagaccccgcggccgccggccggcgtccggccttcccagcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcgggccgggagctcgttggcggcggccggcgtggcgggcggagcgggcctcggagcggaggtgagtgcggatgcgccgcctgggcgcgcgcggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggccgcggagcgaggggctcggggagcgggacctccgggcggggctgcggggagcggggcccgggccgccccattcatcgcggatcggagccgggggtgccccagccgtgccgccgcctcctccgggccgcccgcccgggcgtgctggccccgcggcgctccgagcgcggcataggcttgcgagtcggcggtgtcagcgccccggacgggggtgggagctttggagcccaccctgggggagaccacgccgcacccccgcccagccccgcgcacccccagaggcttttgcagagccgggaagttggctggacgtctagacccgtggggacgcggcgccccgcgtggcggcggccggaagggaaggccaatggggctcgggggactcccgcg

SEQ ID NO: 10682 - DNA, 1979 bp, Homo sapiens
ccgccaccgccaccgctttcctcccagccaccccccacacccgcccgcctaccctccccctaacaccccccacacggctgcccgcattcctgcccctcctcggcctacgcgcgcctcctgcaaccccgacgcccccaggtccccagttcgccctccccctccggctcggagcccgagagccgcctgctctcatttcaaaacagcgataataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagcccccgaggcccgccccggagccccctgtccgcctctcacggccgccccgggcccccacggcccccaggcccgccccggagcccccaatcggcccctcagagccgccgcgggcccccggccacccaggcccgcccggagcccccgtccgccccttacggccgacccaagctccgccgacctcccaggccccccccggagccccctatgggcccctcacggccaccccgggcccccaaagacccccggctgccccgaacccggacccgtaggcccgctccgggacccattattggtccctcacgatcgccccgggcccccaaagacccccgcccacccggccccgaccccccaggcccgcccggaggcccgcggcgcagctccgtcgccggggaaggcctgcaggccgcaaggccgcgcgaatgccccgtgcccgccccgaccaccgcccccagaccagcggcgcctctcaccgtgctccgagggctgcgcggctccgcgacggctcagcggcggggcgcgggcgctgcccatgcagcccgcggccgcgtttcccgggccgcgcggcccgagcggcaaggcggcggcggcggcggcgcgggctcgggcccggcagagctgcgagggacggcgggaggcgagcccgcccctcgggcgcgcccacggctcgggcgagagccgcggctcccggtgcggacgctactgatggggcgtctggccgcgggctcggcggcggcgcctccccggctggggccctcggtccatcgcgcaccgtctcagggcggcctctggctccaggacccagcggcggctgcggcgggagccggccgcatgagacgctcccgcccattggcccgccgtatccgccaccgccattggcccgccccggccggccgcaggggctgtgcacgtcacagcgccgtgagttagtgcgctaatggagtgaaggagagaggcgggattgacagcctctctggcggtccggaggcgggactaggaggacgtcccggtaacgattgggcagggtcctgcgtaagggcgcatgcgacactggaagtagcgagcaactggattggctgcctccgtcgcaaaggagggtgggtcttgcattctcgggcctgacgattggtctttccaagtgccggaagcaacagggatgtcgtctggaaacaaaatctggtattgaagcgcagggagacaaaacgtccacctctagagccgaggcggcggttgcctgtcgcgtgcccgtggtcttctgcctgcccccggacatctcgggccacgtccggcccggcctccggccgcgctgccctaacgggcgtcacggggcatgaagagctctgggcggctgcgaggggagggtaccggggcagcggggcggtcgctcggggctcccgcgcggtgactcttgctctgccgtcgaagagaacggccctcgggcgcgtcgcggccgcggctccagagcccctgggcctcgcgctctgagagcctgagccgcttgaggaggccaagcgcccacgaaccgcattccctgccttgctagttagttctccaacacgcgaaaaaggtagacg

SEQ ID NO: 10683 - DNA, 1930 bp, Homo sapiens
ccgctcaggcagcgcgctgccccgggctccggtagggtggggactggtcgcgaaggctagagaaggcaatggcaggggaggtcagtccctgccgcgggccggctgcagagcggacgttccgccctgctcccggccccctcttcgcccgccgggttcgccgtgtcgaataactgctgtccggagctttcgtgacgcggagcttcaactgctgcgatccggaagaagcgaaaaggagtcccccccgccccgcaccctgagcgcccgggcgtgcaaacgtgggtggcggagagcggctgccctcccctcccctgtcccccctcccctcgcggcgctcccgtgtgtgcgggtgtgtgagtgcgtgtgtctccctcgctcactctcgcacacgttccggcactagtgcaggcggcgagccggcggctctccgctcgctcgctccggcagctgcgttcccgcctcgccccgccgccgccgccgccgccgccgccgccgcctctgcagtcgcagccgggcatggtgagtgagtgaggtccagccgccgcgcgctctcccggctcgccgccggaccccagcctcaaccggctccgtcccagggagccagcctgcggcgggagcgcgctgcggggccgggcggctgggggacccgggcggccgagctgcgcctggaggggcggcccgtgcgctctcggttccaggcgcgcagggccgcgggaccccgtcttgggagcgggctctacgcccctcccggctccgagtctctctcctcgagggctgcgcgcaccctccccgcccgcctgcccgcggttctcctcctgctcccggagcgccagtcgccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccggcgggggatggggctgcccaggaggcgcgccgagcccgcagggggagcgcggagccggcgcgcagcctgagagcccgagcagcccgcgccgggccggtccgtgcgcaccgcgcgccgccgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacaggtgagagcgccgcgtgccgcgcgccccggtctccccgcg

SEQ ID NO: 10684 - DNA, 3177 bp, Homo sapiens
tcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcg

SEQ ID NO: 10685 - DNA, 2195 bp, Homo sapiens
ccgccagctccggccgctaagcaaacattccctccaggagtccgagaagccggtgtgcgaggggaggaaccagcctgaggtttatcgctccagcaactccgggtgattcatagagtttagactcccggttgtcgtagaccgcggcaggcacgcaaacaagcagcccgggagataccctcccctttcccagcccccgctcctccaccttgctaccccctagcccgtgaccagctgcctcccctccccctcgcgggcgctcagggttgagcaaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgccttcccgctccgccgcccggaagagtcgggtcgggacggcggggagtgggcgagggcagaggcggggggactggacatcctgcgggctggggacgccgcgccaactccgctcggtcgctgaaagttttcaaacccgagccggctggggactgggggggtgggggagcccggcgctgcggctcgggctggagggaggggaaaccactccataatcggggtctccaagaggagcccctccaccgcctgcctctcggtgggagtccgcggtcactctctctcgtgggtggcgtcctctctgccg

SEQ ID NO: 10686 - DNA, 2063 bp, Homo sapiens
tcgaggagccgtggaatggaggatcacggcggcgtacggagcaccggggaggaatcgtggggtgcgtaggcgccggagcgcccgggttcggcccggaccgaaggcttgcgcggtgaaggtgtggtgtctgtgctccggggaaagggctgtctccccgggggactgtttcgcagcgaggcttgttttgctcgcagctgggcgctccctggggagcgactgagcgcaagggcgggccgggaggcgcgaggcgagcacgatgctccagggccccaaggactcgtgtgcgtgtgcgtgtgcaaagtggggcggtgcagggcgtgtgcacggcacgggcgagacgcgcgccggtgcgggcgccgggcgccgccgggcgcaattacagcataaagcccgggcgccgcggggcgctggcccggagaacccaccggacgcgcagaaccggatcggcacccctcccgccagcaccctaacgcggagccacagcgcccagggaccggagggcaggcggcggcggtaaaggacaccacgcaagtctccacgtaacccccccgagcagtgcaagctcccaggactggcgcgcgtcccggccactcggagcgcgcaccgctcgcaccccggcgcgctccccgcgcggtgcagggaaccacagcgcgggcgggtattaaggggaaaggaggaggcgtggcctggccgaggagccaatgggccgggaggggcgcgcgggggaggagctcaggtgcagagtgccgattggccagttcgccctccggtatgcagatacggtgggagtcacgtgctaggggccgggacgacttcctgttggaggccaacgcggggcggggaagggggcgcgagcgccccgtctggctgaagcggggggaggggggttcttgtcagttagagcaacaagatggccgcggtggcagctccgcacctcagcgcgacggccccgggagccgtagccgccgccgccggccccgccgccgcgcagtcttgagcgccgcccgggccgccccctgacagggcagtcccagcgcccgccgcgctcccgccgccgtcaccgtcgcagtagccgcgggcccgcccgagccggaggcggagggagcggagcggccccgcgcccagccgtccgcagctgccaccgccgccgccgccgccgcctaggacccggaccccgccggagccgcatcccgccgggcgtgaggaggaggacgcgtcgcggcgttgccggggccggacctggacctgccgggacgcgccgccgcccactcgcccgcgccgccgccgcagccgccgccgccgcccgcgccgggacctgagtccgtggcgccggcgctgagcgggcccccgccgcccgcgcactcccgaggccctcgggcggttgttcgtgccgccgccgccgccaggcccgcgccaccggagccccgcggagccgccgccgccgccggggacggagcccaggtgagcgcggcagtccgcccgctcctcgccgcagccgcaactttgccgggaggttcgcgggccctttgttcggccgagccgagccggggcgggcgctggcccctagcgacccgcgtgcggcgccaggccccgggccggccgggtttgaggggagcggcgggaagcggccggggccggggcgcgtgtgtgctagtgtgagacggggctgtgcagacgcccggtgtgcatcacaatcaaacgggagtggaatggagggctgaagatggatgtgccccctcccttttaaaactcatgcagcggtgaaattcggtcctttccgggcagccccccgcagattttgcactggtgatggcaggcgcgaacccgccgtgttttggtgcaggagcccggtgccgttgtttgggggaagagaaaaacccggggcgtgctgcgggtgggcggagaaggacccctgggcgctctgcggctctgaaatcaggtggattttctaacggtgctgcggactgcggagtaatgcgtatgaggaaaacgagccgtacaacatctgtcctgttatcagataacgtaacccgagcgcctggttgccgcctctgctttaagcg

SEQ ID NO: 10687 - DNA, 816 bp, Homo sapiens
gcgcccggagtgggaggaggggaggcgttgcccgacgcgccctttcaagtctccgcgctcccccccggcggcggctgcccgggggcggtggctcggcgtcgcctcccccgaccgccccctccagggcccctcctccgtgccgcggccaggctgcccggccggcggcgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggagccccgcgcctgccgtctcagccctgggagagggggctctgcccactttccgaggcttgggaccgctctcccccagggcgcccggagctctttgctgcg

SEQ ID NO: 10688 - DNA, 368 bp, Homo sapiens
ccgttttctccacacaggcgcgccgggaggcttcgctctttggccgcgcgactcgggcactcacgttccgcgcagcgtcgcggtcggctccgcgcagcagcatcacccgcaccacctcgctgtggcccatctgggacgcgatccacaggggcgctgtcccgtcctgcgggaagaggaggcggcggccgccgtgactggggcgcccggccccacccgctcacagaacgtctttaacaccaggggtctgaaagcgaaaactccgggaaggcactccctgaccgcagatcacactctgcagctgatccacaccgcccaggaggcagtgagaaaagagggggtgtgtgtagcccacggacgcagacggcacg

SEQ ID NO: 10689 - DNA, 1411 bp, Homo sapiens
gcgggctcccactccgccgttaggagcctttcccacaactctgagaaccggggtgcgaagaaagaaagggcgaaagggccgctcaactcccagagagtagccagcgaaagactcgaggggccccctcccgcaggaccccgaacaactgcagcacctcctcagcccgcggggtccaccaaggagaccctcacaaacaatagcatctgcggcgaaggaaccacccccgcaaagggcagaagcgccagatcctaccagccaattacccagacgcgcatcgcgacccgcaagttcgggcacgctccgcccgggcgcaggcagcgggaggggccgggcacgcccgtgggggtggtctgggtacgggtctgatccgggggcgcgctcgggaggggtctgggtctgagccgggggcgcgcccgggggagtgggctgggtctggggcgggggcgcgtccggaggtgggggagtctggggtgggggcgcgcccgtgggggtggggtggggtgtctggcccggggacgcgcccggggaggcgtggtctgggtctgggccgggggagagccgggtgcgtgctctgggtctgcgcgggggagcgcgcctggtgcctagatgtttggtaccgagcgggtgggggacgccgggctcggagccggcggcaagtctcctcctggcaggtaacaagcctcctttgcagccttgaaggcgccttggccagggccatcccacggcccgggcccccagagcccccccacggccccgaatccgagcagcccctggccctcaactcgccccggaaaggccgccctcccctccaatgtgtggcgcgccccgatcgcctctcactcgtggaacaaaagagcagctcccgcggagcgggtccagagtctgcccggactgtccgatggccctcggccctctgagcgccgcggctgccgggctttgtgtccgcgcggggggcgggaaggacggccggggtccccagtgcgcgtcccgcggagcggcgcgcggcgcccgaactggaaagttgtcgccggcgcctgtcgcctccacgccgccccagtccccctccgcggggcgccccattcattagccaggagactgggcgcagggccgccggggcgggcggggggcttaccttgctcttgacttccactgcgctgcaatcgtagaatcgcaaggtctgagacttgtgaaaacttcggttcatggtttcggccccggtcagcctcgccgtcgccctcgctcctcaggggccgcagaaagactcccgggggcggcgcccccaggccccggccccggccccggcccgcgctcgcttggccggcgggctgctcccggtgctgcgggcccgagctgggctggccgcgcgcctcagggactccaggggccgcgcgcgggaggagcgcgggggacg

SEQ ID NO: 10690 - DNA, 1487 bp, Homo sapiens
ccgcccctgcacctcggggacgtgaccccccccccaggctgacccgttcctcgctctgtcgtccccaggtggaggaggagctgacgcacctccagaagaaactaaaagggacagaggacgagctggataaatattccgaggacctgaaggacgcgcaggagaagctggagctcacggagaagaaggcctccgacgtacgtgtgcagggatgcgggagcccgcggcggggccaggccggagccccggggccgggaaggcggggagagccgcagggggaggaggaagaggaggaggagaaggcggcgcctcccagcgctttctccaaataagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggcggcgacgtgtctgctccaggcggcgggggggatggggggtggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccg

SEQ ID NO: 10691 - DNA, 602 bp, Homo sapiens
ccgcccggccaagctatcttctcgctagcaggtgaggcccgtgaacagccaagctccccttggcacggcggaaccgcagtggacgcgtggaggggctccgtagaggagggacctttgcttgggatgcggggagctgtagtctcttatctgcacccagcttgttagttgtacgcctgcaggactacaatctcagcacaaagcaggattgtagggcggtgcggatccctggagggagacagcgcggtgcgctcctgccggccatgctggctggggtggtgtcttaggcggttccagccgttagtcacagggcggccggactacaatcccagcatacaacgggagtggaggtggtgaccttgagagagggcctgtgctgtgcgcgcctcgcggggcatgctgggagcagtagcatcttagctgcttccggccgctggtcgcagggctgcgggactacaatcttcgcatgaaatggaagagagggtggtgcggatagcttgaggaaggtacggataccttgagggaggtatggatacgttgagggaggtacggatacgttgagggaggttacggatacgttaagggaggtacagcagcggtgcgcg

SEQ ID NO: 10692 - DNA, 628 bp, Homo sapiens
ccggcatccgccgtattacagcggatgggtgcatgcgggcggtgacccgagctcgcgcgggctgcggaaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacagggctgtcgccaaggccccaggaagggttttgcagacgcttgtgggggtgggatcgcggctgacataaaagcgtgtaagtgggtcctatcctcctcactgtccgtctctactcggtctcgaaaagtggcccctgtctggcgttctacccagtgtagcgttggcaaccacagcagccgcaacctaacggcggacgaagactggacgccggaagtcccgcccacgccgctacgggaacgcccctctgcgccttccgtctatggcttggggtcggcttccgtcccttgtagcactgccttctgggtaatgtagtttgacggaatccgggtggtacctggagcgcactttctgttctcggtgaggcg

SEQ ID NO: 10693 - DNA, 215 bp, Homo sapiens
acggagggacgggccgtgcagtgcagccggcggggccagggccaggccgagggcgcgaggtggcagccggcccggggaggcggaggctgagcgagcggtggtgtttgtggagctgtcggctgcggtggaattatgaaaaatagcaggcatcggagccggccttcagcttcgattaggggagatgggacatgacaggtgcgatcaatacgcagccg

SEQ ID NO: 10694 - DNA, 2638 bp, Homo sapiens; identical to SEQ ID NO: 5191

SEQ ID NO: 10695 - DNA, 2172 bp, Homo sapiens
acgggatgccggtctcggccgcccccaccaattgatccatgatcggcttggccagggcgcccggcagcgagagcgccgccgcgccgttgggaggcagcgtcagcgcggggaagaacggcggctggtgacccagcaccgcgctcatggcgaagtccggcgcccggtgaggtaggaacggatggtaggccatgcttgtcccaggaatgaccggatctctcatggagaggctcatccactccaggcggggcgctgggctccagccggggacaagtccgcagctgctgtgttttgttgtttttttgttgttgtttaacagcagcacataattcaaaaggggggaaaaagcaaaacaaaaaagaaagaaaaaagaaaaggaggcagaaatcacaactaatgcacttcaaagggaggaggggaagtgtcttttggagaatgggaggccgcttttaaagagggcaaggcgaaaaatcagcaaacatagtcgcgcgggtgaccgtccttgtgccttgcgtttttaaaaagccgctcctgaacgtcggtttcagaagcgagaggagcgagcagggtctcgactcgcgcccgagccctgccgctgagctcgaaatagacactccagccctgcgtcccaggaatctctctccagcccctaggtcttttgttgcaaatgtgaaaggttctcctagaagactttttacctttctttttcttcttcccccgccccctatctgtcttcctctccctctttctcgctggtggcgtctgcagctgtgctagacccggctttaacagggagcgagagagcggaaaaagtctctctcctttaaaaaaaaaaaaatctgatttaaacccccttctaccagcgctatcaaaacttgaattgcaaactggcttccgttcgccgccctcctcctccttcctctgctccgagcctccggagggtgtctcggtttcaatccaaatcttgctgggctcttctcccgtgcctctctctcttccttgtcctaaaacgtgagcgaattcgcttcctaaatctgtgtccaggcgcgcagggcagggaggatttagagggggaaaaaatggaacagagggaaagagagggaggggagagagagagagagagagagagacggagtcggagagggagggagcgagagaaagcgagagctcctcgccaccctccgccgcctctagaattcaccgggcgtctgctcggcggctctagaaggtcgggctgcgctgtgggctgcggggagccggaggcctcttgattggctctttgacgctttcggaccaattgtgttgctgcataggcgtggttttcacaggtcgagtgctgggggatagagctgagttataaaaagaaggtgtcggaaactgtaacgtcgcagcgccgcatcggtactactgcctgtcctgtgaatatgtcaacatgatcagagggcgggcgggagccactggggagcgcgcgcgcacagagtcgcctctaggtggcttatcgagagatcgctgcagcccctgagctcgctcgctcgctctggttcagcccacgtctgaaatgcctcagtcatccagccggggatcgagggaggaggcagggccaaggaggaagggggagggagagagggagggagccagcgagcaggcgagccgggcggggaaggcggagagcgcgcccgggcgccgggcaggggcgctcgcctctcttgcactccgctcgcctctccgaccgccgcggccggttctctctccagctctccttcttctccccgccccgggcgagccgggcgggtggccgagcctccccgcgagctgccatccggccactcggttctacaaaagccggcggcagccgagaagcgagcgccgagactccaggcttgcgtgctctccagccccacgtggagccaagctccgcccggccgccgctgaagggctcccgagctcgggtgtctcggtgctggtctcccctgcgtctgggctgggggagcacaaggatgcggccatatctcagcacacgcatgtgtgggcttcctctccactgcgccccacccgcagccatgtgcgggtacccaaacacccccggtgtatctgtactcgaacacgcgccaacacactgggactgaaacacacaccgaaaaacacgtacacacaaacacgtacacagcctgcgcg

SEQ ID NO: 10696 - DNA, 2548 bp, Homo sapiens
ccgggtgggcctcgaaggcgaggatggccagaacatgtccctcgtgacaccccttgcccctttctagggccgtgcggcgagaggcgtccgagcactgccaatgtgacgcgggcccacggccgcatcgtggggggcagcgcggcgccgcccggggcctggccctggctggtgaggctgcagctcggcgggcagcctctgtgcggcggcgtcctggtagcggcctcctgggtgctcacggcagcgcactgctttgtagggtaagtaggacccccaggccttgcccagctggggtccccggcgctgggccccgcacctgccgggttgtccggcgggcgacgcgcgggaaaggtggtctctgctgccccctggcggcggccggccccgggcttccccatctcaaggcgccgcgcccgccccgccaggatgccagcccggagggggtggcacggccgggcgagttcgccccctctgggacgggacccctccccggcccgccctccgtgcccccaggtggagaaagcccggcatgcgggcggaggggcagggtctccgaggggcctgcggggtgtgcccctgtccttcctgcgtctcagctgccgctcgacccgcagcgccccgaatgagcttctgtggactgtgacgctggcagaggggtcccggggggagcaagcggaggaggtgccagtgaaccgcatcctgccccaccccaaggtgagaaggcagtccccaggcccccaaggctgggcaccgcacccccacccgtgcttccttgaccctgcgccgcctccccctcctcagtttgacccgcggaccttccacaacgacctggccctggtgcagctgtggacgccggtgagcccggggggatcggcgcgccccgtgtgcctgccccaggagccccaggagccccctgccggaaccgcctgcgccatcgcgggctggggcgccctcttcgaaggtactgggcgtgggtgagccggcgcgtggtgggaagaactgggggtccgaggtaatagagtgtagggaggccgggttgccttggaaaaatgctgcctgctctttcaaagggggaggaatcaaggggggtggtgggaaggggaccctcaaggcggggctcttgccctccaaacctgagccttccaccccttccctgcagacgggcctgaggctgaagcagtgagagaggcccgtgttcccctgctcagcaccgacacctgccgaagagccctggggcccgggctgcgccccagcaccatgctctgcgccgggtacctggcggggggcgttgactcgtgccaggtatgaacccagtctgatgagaaaaggccggctgagccttcccagggccactacggcctcttttccttccacgtctgtctgtcactcgacttctctgagcctctctgtcctcatccctaaaatggacacaagtggcaagctcacacctgccaggcgtaaggcaggcgtcatagggggcaggtgaatgcagcgtcctctctcttggccccgcagggtgactcgggaggccccctgacctgttctgagcctggcccccgccctagagaggtcctgttcggagtcacctcctggggggacggctgcggggagccagggaagcccggggtctacacccgcgtggcagtgttcaaggactggctccaggagcagatgagcggtgagcgccctctttccaatgccccgtccccagtgccccaacggacaaccgtgggacaagcccgtttccacccggcccatgcccattcccagctcccttctgcctcgggaaagcctgtctccttccggggaaggagtgagggggctagggccccaaacagagggtgagctgacccctgtcccgcccgcagcagcctcctccagccgcgagcccagctgcagggagcttctggcctgggaccccccccaggagctgcaggcagacgccgcccggctctgcgccttctatgcccgcctgtgcccggggtcccagggcgcctgtgcgcgcctggcgcaccagcagtgcctgcagcgccggcggcgatgcggtcagttctgttcacccggacccggacggggggcagaggggagggggcctggccagcctctgaccgccgctccgactcctgtccggtccgcagagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggtaccccgcgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccg

SEQ ID NO: 10697 - DNA, 919 bp, Homo sapiens
acgggagccgctgcagggtcaggacgcaaagactccgaggcccttcaggccgaggggacgtcgccctcgccccacccctgcgcccggcaggcccctggtctcgctagcacctgtcgttcagggctggacccacgcggcgggcgggtgaggggtccctggcgcgcggccaccgctcgctctgtgccaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctggtgagtgccggcgcgcgggagggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtgggtgaggcccggggcgtgggaggatcgcccgctctgtcgcccaccccgccgcccgcccgcttgaccacgtcccaccctcccccgcagcgctcggggagccgccgaggagggggccgccgcgcccccgggaccacctgcgcctgctcatctgcatccagtcccggtgccagcgcaacgcgtgagtgtaccccggcccggaccccacacccgcattcgctcggcctccacaagctggaggtggttaaacaggcactggacggggcttccgcccgttcacaccccaccg

SEQ ID NO: 10698 - DNA, 2488 bp, Homo sapiens
gcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccg

SEQ ID NO: 10699 - DNA, 513 bp, Homo sapiens
acgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttccagccgcctttataaagccggcctccccgacccctcctcctctctgcagctctcccctcctcccttgggggctgggaggggacggggcgggacgctggcagccgggagagtggaaaaggctgcacagagccccgtgacaagcccggccg

SEQ ID NO: 10700 - DNA, 1766 bp, Homo sapiens
gcggatggccggcccaggcgcgctcccctacccggggccgcctgtgctcggtgtgccgtgtccgcgggtcaggggcgcggcgggaagtcctcgcccgcccgccagccagcggggtcaaacaggtcatccctctgcggacggccggcgccggagcctccctcccgcccgcccggacccacctccgcaagcagcgctggggctggagccgggcggtccggaccagccccggctcacctgggcggcgctcgcggccgggctcacgccggggaaggctccggccgccgcgagcccccgcccgagccccgcgtcccccagccacccacctgccccccacgccccactcaccagcgcgcacggccccggcaacctcacccggagcggggcgccgccgccgcctctgccgcagcccggccgggccgctgggcgcaggggactccgcgccgccgctgccgctgccgccgccgccgccgccgctgccgctgctgcatcccccggcgagcgctgctgctcctcctcctgcctcctccccgccccccaacgccgccgccaccgcccccggccccctccccgcgcgccgccccagccaaagtccggctccgcaccccgcccggaccgctcttaaatcgccccagcccggccggccacgctgccccagccagccccttggcacggcgctaccgccccccgctcgcctgcccgccggcctccacgcaggggaggcgggcgcgctccggggcggggagcgtcgggccgggagccgcggacggctggggcccggggcgcggggggcccagccgcggtgccctcctcgagccctccgcgcgctagcgcttttacctccggcctgggggacgcgcggcccgcgacccggccctgcctgtccccggcgcacggccccggccccggccccgaagtccagctccggacggggcagtgaacgcagagctggggtcccggcggctctcgacctcccgatgcctccggactcggctggccgcgctcccggcgccgagcgcgcaccctcgccgggacacacagacgcacactcactcgacacactctcgctcctgctcgccctcggcggagagttgaaacagatgtgggattcgcccaggagctggaaacgagggagggaagcgagccagagccttgtgtgcacgtgtgtgtgcgtaacacacaaaccagggggcatcgctaataaatcaaatatcgtgataaattcaggagggccatcgatcaggtccacttggctggaaacgacgtgaatctgcctcttttccgctttcttcttctcctctctcggagctggagggagccaaatgttccgcggggagtgcgacagccccggccgggcgctcccctcgtaatgacacgttaataaatgttttcttttatctgctttcacaggactcgccccggtctgcaaacactcgactgcctttgccgaaagcctcgcgctcgcctccagccacacacatttgccattggagaggccggcgccggccgcgacccgcagctcaatcgcagggcaaaccgagctgcctgtgcgcgcccgagaactccccgagaaattaacttcggctcaagtgaaaatagcagctgttgtccagaaatggcccgggagtagcatagaaaggagaaaccggcttcctccgaaaggggaggaattggactcaagggggtgctgtctaccgtggtttccgctgtccctcgcgccacagaagaggccggagggggaccggcctgacgcgggtgggcaaagagcg

SEQ ID NO: 10701 - DNA, 6511 bp, Homo sapiens
gcgaccccgggggctagcagagaggagaggctgcgggaggactcgctgcgaagggcgaggggtggcgctgggtgggacgggcgcctggggccgtgcagggtggctcctgggtgctgcccgggctgcctgtcgcccagtactggcgcaggaagacgggtccgcgcagcgtctggcaacagtggcctgctccacgcctggaggcgaccaagttctgagttaaaggcgccgggcttagccgggaagtgtatggcgacccagaacacggagcggagaaggcctcaggggacacgaggctaccgccttagtcctcgggcctgcgctccgagcggttagggtgcgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccccggcctttccaccttgcttgatcctggcgggtctgccacttactgaggtccctaccggcgctcacgttgtcccgagaggcgggacaaacgtccggcgcgtggcgcggagtctgcgaaagcgctcgggggcctccatcttctgctcgggagtcccctccctggggcgggaagaggagtcgcagatctgcccgaatcttgctctacccgcctggccgccttcttccgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtgcgtattggggaagggtctcccgtgccgagaagacagaggatttgttctagctgccttccgtacagagggcgcggaggttgcgctccagttcgaacgcttacccattggaaagagggcagcgccggggtccagggaagctccttgggaatgaatggcctttgccaagcggttccggatcctctgggtcctttgggcccacggcacggtgctgcgcgagccctcagtgcccatcggctcccttcgcctcctgcgtagacgctcccaggcggggaggcatatcggttcctccgggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacggagggaactgggcgtctctggcgcactggggctccagctgcatgatcccagctcagaccttaagcctcagtggggtgtaggtgggatgggatgtgtttttaggagatgaggagaccccggttgttgagtcgctccccaaatgcgcagtttcttaactccaggtgacatccgtcttttggaggaacgagtgaaggccgtttaggcgaaagaggggtgggtttcagtatttggatcccttcccccagctctgccaatctcaggtgtgtttacggtggaggtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtccaaaggggtcagatgaggctacctgctagcgacaccttggcggacactcctccaaggccggcttgtcacctgccccgctacctcctcggggaagcacgaaaacaaccgaagtttggctttcaaaagaagtgggggctggggagtggtggtgggggtgcccgaggccagatggggccgtaagagctcgcgagtgctccagcctgtcggacaggttgagctagagtttcggagagtgggagggaagaaggaggcggcgagcgggaagaggaagaagacgcaggcagcgctaggcgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtgcgcatttcccgcgccgcgcactctatccgcgcctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcaggtgagcggcgctgcggctcctgaccggacctgttcaccctacg

SEQ ID NO: 10702 - DNA, 6511 bp, Homo sapiens; identical to SEQ ID NO: 10701

SEQ ID NO: 10703 - DNA, 338 bp, Homo sapiens
ccgccttccgcgcatgcgcccaggccggtccgcaggcctttctcgccccagccggcagccagctcgttcgcgctggggtcaccgcgagccggtccgcagcggggtcaccgcgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcgcggattggaggtttccg

SEQ ID NO: 10704 - DNA, 936 bp, Homo sapiens
gcgtcctgcccgctcattgggcctcccgccggctcatttgcatggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcg

SEQ ID NO: 10705 - DNA, 2184 bp, Homo sapiens
gcgcgttcccttaacccccttgcgttccagctcccccggctccagcaccttcgtgacctgagcaccggcgggctcctgctcactgtccagcacccgacgcacctgtccccgccgcgcagtcccttccccccggcctgagcttccctcccggcgcgcactgcccttgtgaccctttccctccccggccacagatgcagctctcggccagaagctccacttccccgaggccctcgcccctgccaggcagctcccctgcggcgtcgcccacccagagttctccccctggacgctccctcagtgcccccctagcagccccggcggtcttctccccaccttcagccccctccccggtcccccaggaaggggccagactccagctcagcacccagcgcttcctggtctttcccttctgggcgccctcccgacagttccctttagggaagttggcccgctgcgcgctcccacccccggccgccgcctggacagaggcgcgcaatccggagggcgcaggctccggcccggagaagggggtgccgccggcgttccgatttctcaggaatggggaaacagaggcacggtggatccggcggcggggctgggtctggggctggacgttgacctaggaccccgcccctgcccgccctgcgccgcgcccctcccgggccggccttgaccgagcagctccacgcgggcccggggctcgtccacccgacaggagcggggggctgcagcccacgagcccacgagcccgcagcgacgcacccggagtgtaacctcgcagagtcacggagacactttcccggtgtgggcgcctcgccgcgcttcctccccgcgggctgcggccaccccagggcaggacagagccgagatgcccgggtgggagcgatgcccgcgtgggggcgatgcaacgggggagatgcctggggggagggtggtaaggtgaaacctggtggagaacaatgggggtgggtgggcgattcctggggaggtgcccggtgtggggtgtttctggttcgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtgggcgcaggagaaccaggggtcctgcccgcatgcaggggtttggggtcggtgtggccgaatgaacgcgcgggttcagacgagcctgtgatgcccccgctttccatctcctcgcgacctggccccagaagacagtctgagaggccggtggccgcggatcctggacgcgcttccctcctgcctgtggtttccctttattccggcagcgctgtgagtccacccttcactcataggagccacatccagaaccttctcctggggccacagcgtgggcttccgatacctgtgtgaccccagctctgccccttcagggctgcgtggtgaagccctcaggaccctccgcgtgggttgggcgggtgacgtggatgagggacaacgtggtgaggtccccgtcgtggcg

SEQ ID NO: 10706 - DNA, 413 bp, Homo sapiens
ccggggcgtgggagttgcgctcgctctcctttcccggcgtcccgtggagaccgggaggctcagcgcctctcccagctctcagcgccgccctcccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccg

SEQ ID NO: 10707 - DNA, 403 bp, Homo sapiens
tcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttggggttcgcatatttgaaagcgtaaacttgaggaatgacggcggggtgatgggtattttatagagtgggactcaatcgtgctcagcaacagatttctccaaattcccttttaaaaagagcctcccagagctgtcgaaatctccgcggggtgaaagctaaacttttggagtcgctgtgtagccgggtagaggacacggcggcgcgagccg

SEQ ID NO: 10708 - DNA, 675 bp, Homo sapiens
ccgttcttaaacgcacgactacttccctagctttccagcaccaaatccagcggccccacccggccacgcccccacgccaggccatgacccccatatggctcactgcgcaagctcacacccagtcccaggaagcgagccccacgtcgccccagctctgcattcacagccgccaagcggtcccggaagccgaatgccggataggtcaaagacagcgccgctgctccggcactgccgccagagggcgcggagtcgccgtgttggcctgcacctcccttgtcacgtcagccgaacggctacggcaatggaggattttgccgtatgcgacgacaggatgactgcttcccctgaagcttcaccaaacacggagaggctttcctgtccctgggagacgcggtgatgtgacgcagcggttgcagcgaaggtttcttgtaaaagatggccgctgcggagttgctaggtgtctcctggcaggcggcggccgcaccacaagatggcggcccgccccagggtcccacacgcggggctgcggaggcggcggccccgagggtccccgccccttgctggccctgtccccgcgtgcggggctgcgacctgcctttgtgtgcgggtggaagtgcgggccgccttggggccgagttgcaacttcgcgacactccactggagtgcgatgagacg

SEQ ID NO: 10709 - DNA, 580 bp, Homo sapiens
gcggtggccgaggacgccctttctggcgtccgggggcaccggaccgcggctcgccgggatggaggcaggcaggcagcgtctcgggagggctctagggagcggcccggagctgctcggcggggcgcccagggcgcagcgggcagcgcttaccgagggcgcgcaggtactcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctgcgggaggatccattgtagcggtcgctcctccccgcttagcgagggcgggcgcaggggcgggggatgtcgaagggtcaggtttgtccaggccgcgccaccttcgtttcagacgttcagttcgtttcccctacaaaggaagaggagaccggagacgggacgtttgctttgttggccgaactcttcg

SEQ ID NO: 10710 - DNA, 858 bp, Homo sapiens
tcgggcacgctgagttcaccgagaactccaaggagtcaacgagggcgggtgcccctacacttccccagggaccagcgccgcccgaccgcaattctggggaagaccccggcggtcctggagaggagggacaggcccccactactcacctggccagccccgcggaagggctggtggatgaatgaactgcccccccgccggccgagcctcgcgggacagcggcggaccgcggggtgctcacctgtggggatgctcgagggcttctccgagtccgcacccagacagggattccaggggtggaggacgagcgccaggagcagcagctgaggcttcaccgtgcatccccccatattcggccctcgagggccgcgcgggctcaggcgcccacggccccgcagcgccgcgcttctcgcgagaacgcagagacccgggtccgccctgagccgccgattgcgggcgggagccggcgggcaaggcgcgcggccggcagccggagcggcgcgtaacgcagctgagtgaggtcgtcggtggaggcacggagcagcaggcgcccggggcgctgcggaggccttataggctccccgaggggaggcgacggggcgggccgcgccctggctattggccgccggctgacccgccgccgctgcgcgcccggtgcggtcgcctcagctcgccctcctgggccccacgtctggactgtttgctcagcgcggacgctatttaaggagctgcctgcggctacgtgtggaggctcacgcagcgcttctggctggaacggggaagcctgcacttagctttgggagtgggtttgggagagggaggaggagccgccgggagtctggcgggagggcggtgttcccg

SEQ ID NO: 10711 - DNA, 5715 bp, Homo sapiens
ccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgtagccgtcgtctgcccccaggttgctgctggagctcctgtgggagccgatctcgatgtctccgtagtcctctgggtaggggtggtaggccaccttgggagaggacgcggggcaggacgggcagaggcggcccgcgctgcccgagaaggtggcccgcatcagggtgtattcatccagcgaggcagaggagggctggggcaccggccgctgccgggctggcgtggtcagggagtaggtcctcttgcgcagccctcggtccaggtcctgggccgcgtcccccgagacccggcggtaggagcggccacagtggctcaggggcctgtccatggtcatgtacccgtagaactcaccgccgccgccgccgtctcgggccgggggcgtctccgcgatggactcgggcgtgttgcttcggtggctgcagaaggcgcgcaggtcgcctgggctggagccgtactcgtccagggacatgaagccggggtcgctgggggagcccgaggcggaggcgctgccgctggagggccgctggccggggccgtggtgcagcggatgcggcagaggcgggtgcgggccgggcggcggcgggtaggagcccgagccgtggccgctgctggacgacagggagccggggctggtggcggcgggcggcgagtgcgccacgggcatggacatggagcggctgtgttgcagcgcgccccctgccggcagcagcgccaccttgctcccgcggccgccgcagccgccgctcagggtgtgcgagcggctcaggggcgcgcgcaccggcccggggctcagggggctcccagccaccgacaccggcctggcgcccgcggccgccgctcccgccgccgcgccgccgtcgccctcgctggcggtgcgcacccggcacgagctgcacttggccgccggcggggtggcggccaggctgtcggtgcgcgagcggcgcaccaggcccgtctggctggggggcaggttgaccaggtggtggtggcggcgcgcgccggggacgctgatggggtgcgtggccgacgaccccgacgattggctcttactgcgcggccggaactcgaagagctccttgagcgccttcatggcctccaggatggtctcgtggatgttctgcgccaccaccgagtcgtccgcctgcatccacagctcgccggggcctgtgacggccgagcggcccacctcgatgaagaagaagctgtccgagtggccgcagcggcggatgttcatgagctgcagcgtcaccgacggctgctcgcagttgagcttcacgaagccgatggtgcgcgcagacaggcacagacggtacacccccgtcaggttcttgctctggcccagacccttgggcttcaggttcacctgccacacctcacggtaggcggccgtggcgggagccaccagcccgtagctgtcctcggccccggcggcgccggcagagccgcccagggcgccgggcagggaggcgctgcaggacgcggcgggcgcggcggcggggggcgcgtctccggcggccgcgcggccctcgctgaccaggtcggtgagcgcgcggtaccagccctcctgctcctgctcgttctcggcggccacggcgaagtactcgtccttggtgtagagggcgatcaggtacttgtgcttggcgtcggcgcgcttgttgatgttcaggcagcagtcgagagcgatcacccgtttcggcgcgcctgccttgctccgccactttttctcgctctcgtagtactcgagccgcggcggttgcggcgccgaccccccgcccgccgtcgcctcgtcgccgcccgcgccgggtccgcgcagcacgaagaagcgcttgtggccatgcttctgcttgcgcaggtagccgcacttgcgcacgctgtggttgttgttgttgttgttgttgttgaggttggggccgtctccgctcgccggcccgggcggcccgtgccgcggcgggctcgccatcgcgggcgcttcaggccgcgcggcccgggcccggcgcccaggggttggggcgaggggcggagggggcgcgggcgggggcggctccctcccacccttgcgcccggccgcccgcccgatcacgcgtccctcgggcccaggcggtggggaaggtccggggaggcccgcgggggccagcaccgctcggcggcgccgcgccctccgcgctctggggctcctgaggatgcccggcgcgggcggtggccgcccccctccccggctgcctgcggccgctgcctcctcgggctctcgggcggcgccgggggacgcgctcgctgggccgggagtcggggtccccgagccgcggggccgagcctaaggcgcgcgcggccgcaccggggctgctgccgccgcgtcgcgctccgggaagccggggtgcgcccgggcgctcggggtccgcgccgccgccggggctgctgctgctgctggtgttgctgctgctgctgccaacggcgacccgggctcgtcgcggtccccgccgcacagtgagtaacacatcgcgcaccgagtgactgaactaagaagagcaaaacaacatgtgactcggcgttacgcaggcacacacagcgcggccgccccgccccgctgcctcgcattggcgccgcgccccccgacggacggcgcgctcggccaatcggcgcggcgctcgcgggggcgggccgcgcgcccccgccccgcccccctttctccccgggccgcgtttcccgccgtcccctccccctcccgcgaaggccccggcccggccgggcggggtggggcggccccggcctcattaatcagcggcttgttgtggatgccggcggaggagatgccacccagggcgggaaaaggggcgcggaagaggggcggggcgggccacggcgcgcagggcccttccctcccgcctcggactcaattaattgggcttgagcttccgccggggagggggcgccgggcggggccgcggctgggcggggcgggggatcgggatcggcggcgggggctgcggccttgcagtggaagcatgggcggcgagccgggccgtgctctcggggcgcggggtccccattttgggcgagggcggccgctcccgcgctcggggtgggcgcgccccatccccgtcccccgtttcccgtccccgtctcccggccgcatctccgtccccccgcagccgcgaaacgcggggaggttccagggcccgcggccgcgggttcgcgagcaccgcgctccagatcgagagcggcgcgcgcccttccgtggaggacagaggggcgcggagggggcgcctgtgtcccacccgctcgcgggcgctttacggggcgtcctctgcgccattcacttgtcagcttgtcgggaagttgaaatcgcgtttgggaggtaataggagaaagagatcggggacggcaggcggagaaagtgcggtttccatagcgccggggagagggcggacccgcgagccagcggtccctgagccgggagaccgcgcgggcgtctctccagcccccgcaggagcgccgccttccttccgcaggggcgtcctctccccccaccgctgcaggagcacccccttccttcctcggaagcgtcctctcaccacaccgcttcaagagcccccccttccttccacaggggcgtcctttccccctccgaggcaggagcgccccttttccccccacaggagcgccctccccaccccaggagcgccctgcgcccagcagacgggcaggtgggcgggcgtccactacctgtgtgcgcggtgcgggcg

SEQ ID NO: 10712 - DNA, 858 bp, Homo sapiens; identical to SEQ ID NO: 10710

SEQ ID NO: 10713 - DNA, 247 bp, Homo sapiens
ccggaaccttcggggaggattaacgccggcgcaccgtgcggccggggcggggcgccgcccaaactcaggccctgtgacagcgactgtggcggtctggaaagcgtgggcctcggtcattgggcacgagcggtcacgtgacagcgggttcctccaggccagcgctggtggttgagtgatgtaatcacgtggggtctgaagtcttcgtgggtgtaggtttcttcgttatgctgacgacaggcagtgcccg

SEQ ID NO: 10714 - DNA, 224 bp, Homo sapiens
acgcccgcccctcttccgggcagccccttccacccaggcgggatctgggtccccgctggactcagggccgccttcccgcaggcggggccggcccggcgcgcaccttgtctcggatgccctggcgcacggcctcgcgctccgcctccatcttggcgtacttggccttgcgctcctcctccgcctggcgcagcgcctcctgccgctcctcctccttcttggcggcg

SEQ ID NO: 10715 - DNA, 1174 bp, Homo sapiens
gcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtttctcattaccgacttttcttccagccggaggggaggaagaattcaagtgggggagggcgcgggaaggggacgtggagggaaacggaagggctgggagtggggtaggggggcagtggcgacctccggggggggagggtggcggacaccagaccccagggccgacagcccgggagggaccgggttccaggaccccagctgcacaaagccggcccggggagggggcgataaggagcgagcctcgggtcggcccggcaccgctgcttcggctcagagtccttgcaatcgcttggcctacgaacaacctaaatgaaatttagggttttattgaaaaagtcccctggggcctaatttagcctctcgactccagcctatatgcttacaagtcctcaggggactccggctaggaagtcaggagtggggcccgtgcgtccccggcaggacctagactgcctctcggcgcaggcggccctaacaaagaagcccacgaggcggtcccgggcgcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcg

SEQ ID NO: 10716 - DNA, 8657 bp, Homo sapiens
ccggaccctccctcgggtctcccgggcgctccgcctccccggggctggctctccctcccctcccgggcgccgccggccgcgggccgcctacctttcttgggctcgtagccgccgcccggggaccggtagtgggactcgagcgggtgcgcgcccgccttgcccgcgtcgctggccgcctttggcgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcccgggcccaggctcggctgcttgaggtccgacgtggcgatctcggccagcgaccacagcttgggcttgctggcggggggcggcgcgcccggagacgtccggctgccctggggcgtcttgcggccaccgcggggcgcggcctcgggcggggggctcagcagcggcgcctccaagccggtaagcggcgacgaggtcacgggcttgggcggcgccaggccccgctcgccctcctcgtcgtcgtcctcgtcgtcctccaggtcgtcatacttgtccttgcactccgagcccgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtccggcgggcaacgtcctccccgccttagctctgcgccccgcctgggaagaaagcgccccgagaccttgcgccggccgctgcccgctcaccttcgtcctctgccgaggtctccgtgccctcctgcgccttgtcgggactctcgtccttgcttctggtagcgtcgccctcgtcctcgtcctcatcttcgcttttgtttctcggggcccaggtcatcttgttctccttcttgaggcgccggcgcgcgttggcgaaccaggtggagacctgggtgagggtcatcttggtgatgatggctagcatgatcttctcgcccttggtggggtaggggttcttgcggtgctcgttgagccaggccttgagagtggccgtggcgtcccgcgtggcgttcttgcggtacgcggggtcgttgagctggtacgggtaggccgcgctgccgtacgggtggtagctgatggcgccggtcatgccggtggtgtgcgcgtcgtagggtgcgccctggaaccaacaagagcctgtgagtggagtatgcggagaccccgcgggcaaccagccagaggatgccacccctccgcccgcccacggccaccgttccccccgtgagtctggctctggggctgcgcttcccgccgcaaaagagcaggaaaaacgcagtgtgattcgggaccagctgttgatcacaaaaagtaccggagttttattctcgaatttctgaactatttcactttcctaaaatgacccatcttcccctaagtgttccggagccgctcgtggcaatgtacacaaacccttgcacgtgcgcgcacacaggcccacaggtagctctttgatatctaaatttctgcagatgcttggagtgcggctgcctccccctactccctcttcccctcccttatatggttaaaaaaacaccccagagcccccaattcactattcactgctctaaagctgggcaaatccaatttgcaactcagaagccagtcaccgtttcgaattcttcaaatacgccgtaattagcattttaattcatcctttaacgtttaaattcgaggcatttgcagccttcgccaaggccccagcgactcggtcgctgcccagaaattccgccgagggccggcagtcgcgacaaccccgtaatggcctcaatcgcccgtaacgtgcttcgccgcggcccgggcctggcccagctcagtaacctcgagactcgcgagccgcccccaggtcgccggagcaggagctgcgctcgggccacggaggactcaggcggcccttagcgggtcacgcgcccgcaagcacgatatttgaaagcatggtccgctggacagagtaaggccgaaacctgggcgcctcgggccggactccggagccgcagctgaatgctcggctcctgggcctaactcggtgacccccaccgccctgagccccgcgagtgaatgcgaaccgcccggccgtcggctcagaggccgcagtgacgcggaccctcgcgccccacgccaatgcaggcgagcacacagcccgctccgaacgcctccccaggctgcggtgcggaaaccagggacaaacggcgccagaccccggccccggcggagacgcacttcccaggctctcagagaaaatcagccggcgagccgaggggacgcgcggggggcgcgcgggtcccggccgggctcagggacgtccccgcctgccgcgctgccctccccacccggggcccggctcagcctgcggggcggccaaccgagccggcgactcctgagtcgccagccgcgccacattcccggcggcccccgcccgccgaacccgagccccgctccgcctgagccccgtctgggtcccggcgcccaggagtcccgcgtcccgcccgcgcccggttaccatgtaggacgggaagccggcggcggcggcggcggcgtcggccgagtactgcagcgggctcccgaagccggtggccgcctgcgccgtgaaggccgccgagcccgggtaggggctgaacgccgagcccgacgccgagcgcgccagctcctcgctgcgcggagccgccaaagccgacgcgccgtaggccgggcacgagtagagcgccagcgagccgggcgcctggtacaggtagccctgcgggtaggacatggtgggcgcggggcgcggggcccgcgtcacgccgagcagcgggcagggcgcgcggcgccctccatccacgcccggccggggcgcggcgcggcggcgggcacccggacggccggcggaggcaggccggcccgggtactagcctgggcggcccgcgggccggggcggcggcggggtggcggtggcggcggcagcagcgcggagccggtgggcgcagccgcgcgccaggccggcggtcggggtttgggggagtctggagtcgggagtgaggagttgaggaaggagcgctcgagtttccgagggacattggaacgcgcagctgtccatcacgcgctcatctgcatattcgggggcccgcccctcccctgctccgcccgctgcagcctccgggccgcggccgggggaggggcagagagacgggagggaggcgggggagggcggaggcgacggaggcgggcggcgggagggaccggcaggcttttgtggcgcagccgcctctctagcagctccggccccagcccgcggctcgcggacctgcagcccagcccggccgcgctgcgtgccccggcgcgcacccctcccactcccatccactcggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcccccaccactcttcctacaaaccacacccccatcctgcacacatcctcttcaggccatctcaacacacgcacacgcacacacacccacgaccacctctccctccacccacagacaccccgttcccacaggctgggccccctgcaacgacccagcggggggtttcaaccttgttgcgactccacatgggacatcctaattcagtccaggacagatatttttaatcaattactatagagctgaaaaacagagagagagagaaagcagccgggttgggcaagccgtcgacagtctgcgacatttttgcgcttcctgggagggaattcctccaagaagaggggtaaatgagaggcccacacgctggatggcaaacacaaacactgtcagatcagatggcaacctttagggttcctttacgatcagatcagtttaaatgaaaaaaaaatcgggtgtaatttttatcaccagggagcactggcctggagtatttccatttctaaagagcggttcccgctgtggtttcattagcatttggggctcatcctccctccccctcccttgacccacccccctccccccgccggacctctgccaggggcagaagagaaaacagccagttattatacaaacatcctcagtttggagctggagtgtctgctctggatacagtcgattctgacatcaattaaatatataaccagacacgtgcagtggcggggagggtcccctcacccagggtgcatctccagaaacgccgcctgcccttccccctctttagctcagtgttgggagtttgaagatggcctcttcccgtcctgtgtgtattttccccttagcaattatactcctccactgaaatctatatgttccataccgctgctgcctgttactaataaaaaccgtctaccttgcactattaaacagtcgactcttactacatgccgtttttattggtagtgactgtagcaaattaaaatgcctacgcagggacattaaaaacttaacactcgtcattgttattgaaatatataaactacgttttgctttaaagctctctgatattaaagaaaaaaatcacattccttcttcttaagttaaagttggcttggtcttcttcttaaaaaaaaaaaaaatcaatcatgagaaaacatgctgccagcgtggagtcttggcgcggcggtcccggcgaggctgcctgagagggtggcgggctcagcccagactccgtctcggggccacgagggctgcaaggccgcggctcccgaagaggagggcctgggatgttttgctcaagggcgaggcggggtgctcaggcctgtggggtcgctggggagagcccggcacttggcttctgaggcttttcagttgccgtccgagcaggagggagggaatgagcaggcacgcagggaaaacccagtaactgctttgcaaacgcgacccctggtcacaataacccaggcgatgggggcagtttcaggttcctggtgggccctgccccctttcctaggtgtgccctaggaggtggggaaaaaattaacactgtttctatttttctttattgtccctgcaacagccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggtcgggagcccctcgtggccaggcgtccgcgcggctcaagaccgaggtccgccacgctgggccgctcgtgggcggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcg

SEQ ID NO: 10717 - DNA, 1059 bp, Homo sapiens
tcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccg

SEQ ID NO: 10718 - DNA, 1663 bp, Homo sapiens
ccgcctcccggcccccgccccccgctccccgggtggtgaacgcctgaagagggaggcgtggtcccgcgcaccttgtctccggccgcgccaccggcactcacctggctgctgccgtgctcctcgcccgtctccggggcccgagactccgcgggactccgcgccggctctgcgggaggaggcggcggctccagcagctgctccaggcaggcggtgcccggcagagaggagctcttctggtggcacaagtgcgccccggggccctgacgccgtgcaccctcatctcgggcgcggtcccccctcgggggaggctggggcgaggaggacagggaggatgaggcggaggaagaggaaggagctgagtcgggggagcgtccgccaggaggcgtccctcccgctgctcccgaggccgccgcgggcccctttacggcggggagcaaatgctcgcggatccggcggcgtagcgtggacccctgctcggctctgccggcgccgccgggctccaggggctccggcgacgagcagcacaggttgggctgcgaggaggagaagactcggtccagcacttgcttccgcttcttgaagccgctccacctgctgcctgcaccactccccctggccggtgcattccctgtgcccaccgggggtggcggggagggcgacggggtgtccgcagtgcggcgctctggacccccagcgcgcccgcccccgccgcccttgctcctgcccacccccagctgcaggttcttccagagccgggcctggaaggaggaggacgccgccggcggctctggctcgcccgccgcggcagcccggggctccatcctccaccccctgctcctcctctcccctcctcctcctcctcctcctcctgcttctcctccctcttcggctgcacctcctcccgggtccccgcggcgctggcggtggcggcggcggcggcggcgggcgcagcagcagaaaccgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccccaggccgcgccctggctccctcttctctctgaccgagctcgggaagctgcacgcaccggggcgtgcgcgtccagctgcgccagggaccgcacccggcgccctctgggcagcacctgtcagcggcgggggcggctgcctccaaattgggcgcgcacgcggctcacacaacaaggcgcgtctggctggagactccggggaccagcagtccccctggggcgccccgggaccatcctccagctcctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcg

SEQ ID NO: 10719 - DNA, 2065 bp, Homo sapiens
gcggaccgcggcgtccctagggaacacacccacctagcaaccgagaccagagctggagcgctgcgcctttaattctggggcgggcggggggcggcgggaatttctgctccggttccctctgcatcgcgggggcagctgtcacctgtaaggcgagcgcggcgcgggggatggaagcaggcgcccattggacagaatacaaaggcagaaacctaccccgaaggccggggcccggcggggcgctgggggtgggcgctccccgcggcccccggcgcccttcgccccgagacgccccggcccagcggcactggcgcgaccgaggtccagcttcggggacacgcccggctggccgcggggaaggcaccaggtgagcgcggccgcgcctcccggaaccccgctcccgcgcgtcccgcggcgacgcggcgcccacccgccccgggagccaggaacccagggccccaccatggcgctggccgccgccgccgccgctgcggctgccggggtgagccaggcggcggtgctgggcttcctgcaggagcacggcgggaaggtgcgcaactccgagctgctgagccgcttcaagccgctgctcgatgccggcgacccgcggggccgcgccgcccgcagggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggagctccgcccttggtccgggtgccgcggccagtggagccgccaggggacctgggtctgccaacagagccacaggacaccccgggggggccggcctccgagcccgctcagccgcccggggagcggtccgccgacccaccgcttccagcccttgagctagcccaggccaccgagagaccctccgcagacgcggccccaccgcctagggccccttctgaggcggcatcgccctgctctgatccgccagacgcggagcccgggcccggggcagcgaaagggccgccgcagcagaagccctgtatgctgccggtgcgctgcgtcccggcccccgccacgctccgcctccgggcggaggagcccggcctgcgccggcagctgtcggaggagccgagcccgcggagctcccctctgctgctgaggcggctctcggtggaagagtccggtctgggcctcggcctgggcccgggccgctccccgcacctgaggcgcctgtcgcgcgccggcccgcgtctgctgagccctgacgccgaggagttgcccgccgcgccgccgccgtccgcggtgcccctggagccgtccgagcacgagtggctcgtgcggactgccgggggccgctggacccaccagctgcacgggctgctgctgcgcgaccgcggcttggcggccaagcgcgacttcatgtctggcttcacggccctgcattgggccgccaagagcggcgacggcgagatggcgctgcagctggtggaggtcgcgcggcgcagtggcgcaccagtcgacgtgaacgcacgctcccacggcggctacacgccgctgcacctggctgcactgcacggccacgaggacgctgccgtgctgctggtggtgcgtctgggtgcccaggtgcacgtgcgtgatcacagcgggcgtcgcgcctaccagtacctgcggcccggctcctcgtacgcgctgcgccgccttcttggcgatccaggcctgcgaggcaccacggagccagatgcgaccggtggtggaagtggcagtcttgctgccaggcgccccgtacaggtggccgccaccatcctcagttccaccaccagtgcatttctgggcgtcctggctgacgacctcatgctccaggacctggcccgaggcttgaagaagtcgagctccttcagcaagttcttgagcgcctcgcccatggctccacgtaaaaagacaaagatccgcggtggtctgccagccttctcagaaatctctcgtcgacctactccg

SEQ ID NO: 10720 - DNA, 3487 bp, Homo sapiens
tcgagagaaggtgagctcggcgggcgcagcgggttgggtgggtgtggcccgcggctccgggaacagacccaaggccccgccaccgccggctagcagcccgacagcccgcccgcctggcgagcgcaggctcttcttccagaaactgcgaggatccgagcgtactgtttgtgcaccacaaggtcaagtcgggaagtggagccggaggaggaggggcgaggaggcgaagggtggggagaggggcgccccgcttcctcgccatgtgccagcctttggaagttacccctcggtttttaacctttcggggtaatgggaaggaagagcaaggaggaaggggtcgccccggggcaaaatcctgctggggccaggatgtgcaaccacccacccacccgctcatcactgccttctccaccccccggaaatgcggggcagcgctaggcgccaggaggcacccgggaggggggagggggcgacgagcccaatggggaccctctctacggaccgcccctcttttcttgaggtcgcctacaatttcaagttcccccgcccggaatgttagttttccatttggagtgggtgcggggaggagggccgcgccccctccccaagactcgcgttcgcccctccactcccctcctgccagcactttctgctcacttctggtgctgcaaaacgccacgcaatttattcgattcgcattttaaaaccagcgattcagaagcagggcctagggcgagggtcttccagcgctggagccccggggggcggggtgctcagtgcaaacctcgttccctccgcgagtgtcgcctccaggctgttatttgcaaagaaacgtctttttgacgcagggagaaatggcaaattttaagtacgtcattaatatggcgccaaaagatttttttaagtataagctcgcttttttttttttttaaggttgcggggggcgccgcccgggtctggggcgcgtagggggcggggtgtgagcagaaagtgtgagtgaaagagtggaggggcggggtatgtgtgtgagtgtgtgaagtgtgagcagacctgatgggacttgcacgggcgcagccgccgctcgggcccggccctggggacagggcgggctaggggcgccccagagtccatggggagtccgggcccagggtgccagcaggcgtggtggtggggctgcgagggagggcacccttcccccacggggcccgcaacgctacctggactccccgccggagccaaacaactgggcggggggttgggggggcggcgacgggggtgtcgggagcggagatccgagtgaataagaaaaaagtggctactccccctccctcgctcctcctgcccgcccccaccccacccccaccccaacacattttttttttctaaagagatcacaaggaagtcttggtttaaaaagaaacagaaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggccgcctccctcgccgcgaccccggatggatgcgcgccccccgccctcccgcgccggccccaggagctcccggcttcgggagcatccttcccgcgccggtccctgcagcggcgcgtagccgagggcagcgcccgtcaggggggcaccgcggagcaaggtaagatccagcccccggcggatgggccctgcgcatctccacgacgttatttggcgtttttgcaacagatctgccagcgctcttcgctccctcgctctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaagggtgagcttggcgaccttctttattaatgactgcggcaaagcgcccccgggccggcgagggggcgcgggcgggcgggggcgcgccagggctgcaacttccccgcgggctccggccgggcgtaggggctgcggcgggagatgggtacggtggggaggtcgagcggcccgggcgggggctccgagaacctggagctatctgccctcctgtctccccgagtttcattttgttgatacgcagcacgtccgggcgccgaaccgggctgagccggtgcacatgacctcgcgctgggctcacgtgcagccggtccggtcccagacaccttccgggggccaccgcctccgccctgtcgccccctctcccggcccggtgcacgcgggcgctgcacgcgggggcagcatgctcggctcctggggttggaggctctgcacaaattagacagtttttttggaggggcgggggacaccctttccaggtgagtgtggagggtgcggagcctcggcgccaggggtgaggactggggtcgggggcagcctccacctccggggccgcgcggtagtccagctggggagaggcgctgggagagtggaaatgtaccggcggcggccggagcggcgggtgcgcgcccgcggggcgacggcagggggcgtggcccttgtttaccttctcccaactctgccggttcgcgtcccgcttcagggacggatccgcagtccccagccctctgcctagggccctgcaccatgggtggtaccaggaagatgccggcttgtggcggaccccgtttgggacgcacacacctgactctcaaatgagtgacattgcagcccccgcccccacctagcgctgctgcagtccctttgccggatccccggccccgccccgcccccggcagtggcatcttcccggcctcacctccttcctccctctccctcccttcttcccacccactcgcctgcgcctgcggagcggcgcccgcccgcctcctccccgcctgggtgcagacttgtggctccccatggtttcttcccgcccatccctgggtcctgagacatcctctcctctcggccaagggacgagaggggtcaacttggcgattcgcagctgttctgccagaggatggggttgcctgcgagacagccaggaaggcttcactctagcttccagaggcccagccctgtcccctactacacacagctaccaccccacccgcccctggggctcggctgcccttcccggtgtctcttaaacccctcccccgacctgggtgttaagcccacccacctcccggcgccgcccccggtcgaacagcctcttgcccttccttcgcctgggccggagccccccgcagcctcctccggctcctcctcccggctccggcggtcggaatcacgccggcgcgcctccagcctgcggtcccgcggactgcctccaggggcgggctggaggcgcgcg

SEQ ID NO: 10721 - DNA, 847 bp, Homo sapiens
ccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggccggcgctgccccgctgcgcatcgctgggagtgcccaggtgcggagcgccccctggccccgctggcccgcgggccgggttggggacctggggcgagcgcaatggggcgtggcgcccggggaggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccg

SEQ ID NO: 10722 - DNA, 909 bp, Homo sapiens
ccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccg

SEQ ID NO: 10723 - DNA, 2150 bp, Homo sapiens
acgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgtttgctccgcgccgcgcggcttgcgctctccccggaacgcccacactctcaatcgctacattgttgacattcggcgctgacgtcacccgctccccattcacaataactttacgggagccgggcagcgcacctccccggccgctggggcgcggtacgcccggcgactagcgtaagccgctccgcgaatggcgctccgggggctggggcggggggcgggggacgggggcgggcgcgcgcgctccgctggctcgcgggagggggcgcgcctcatgccgccgcagcagcagatctccccgctttgtgcggccgcgcggcccggagagccccctcctcccggcccggctgaccgccccgctcggcctggccttcccggccacgaaagacg

SEQ ID NO: 10724 - DNA, 506 bp, Homo sapiens
gcgcccgctgtccccgagctccgggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcg

SEQ ID NO: 10725 - DNA, 1503 bp, Homo sapiens
ccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccccgctgggcgtggggtcggagacccggacccccgcaactttgggtgcccgcggcccaacagctgaccggccctcctggaccgagggtccactgggcccttttcccgccgcccctctgccctggccgtagacggtgaccttcggaccggccctggtcgagcctagtgcttgggtagggtccagggcgcacgggctgcgcgcgggctgtggatgcatgacgccgaatggtttgggaactgacttggagaggagtccccggtggctaagtccccgctccgcctccttgtcgcccccagccccacctcgcgagctcgggcattgctcggggctgggctctgggagaaagtcctctcgccttgcccagctcagagggcgtcctgagaagcttcaggtgttgtagagacgcccggtcggaggcggattcccggggaaagcctatttctgggtacccaggagcgcg

SEQ ID NO: 10726 - DNA, 907 bp, Homo sapiens
tcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgaggaaaggaggggacggcgctgcggcttcggaatctgtactgcgactttggcagagtaaacgctgcacttgcagcttcgaattgaatttcctgcctctcccccctcccttccctggccacgctcttccctcctcccctcactattttaccttaattggctctaaacgagggtgaaagttgagtctgaggatgccgctgccatagaaactgcatagcaaccaagggctggggaggcggggggggggggcggcaggtctttcccccccacccccagcacgcgcacacccttccccacctccccagcccgccgcgcctccccggagacccacaccgccacctcccgccgcagaacgggagggacaggaacacggacggagggaccgggacgaggggagggctccacgcagcacagctgctttcctgcggagcgttcaggagactcgggcacctctggaagcgctgcggactgagctgcccgcggctgcccccgccccgagggccgggacagcacctcaggagaagagggacgaagagggacgacagacaaatagctggggagaggcgggggggggcggcccgtggggtccgctgggccctacccagccctgcccggagctgcccgaaacagcactcaggcctctgcgggccaggatgaaaggcacgtgggccg

SEQ ID NO: 10727 - DNA, 1925 bp, Homo sapiens
ccgtcggccccaagcaggaaggcgcccccggcacaccagcccctctcagcgcccccagcgggcccggcgcctggagggttaaggcgggcgcgtcccgcgggtgggcggggggggggggacgggaccggtgccgggagctccgctgccctggcgtcccctgggtccaggcccagtcgctccttgggcctctctcgcggggccgcctccgcctcctccttgccgagacgggcgtggggcacggggtcgccgcccggcggggagctcatccggcggcgcagacgccccgcggctccggggagggacttggcctgggccccggccccgcgctcctctggggaggagccgagaggctgcagctggcggcggcggccccgggcgggagggggtcccaggaagcggccaggccggagccccccactcggccgcagctgctggcctggccagaaccgagcgcgccctcccggtctccgccgcttccctctgcaaaccgcgggcaggaggagccctctccttagcgggcccggagctcagaggcgtcgcggggcgcggccgaggggaggaggaaggagagcgggagcgcagccggcccgggcccagccgtgactcgtggggcggcggctccgccaatctgtgggcgctgacgcggggggcggctccgcggcgctcgatatctgcccgcccgggacgcggggcgccgagaggctcggccaggcgggagctgcgctcggggcggccgctgcacctgcccgggaccccgccggccgctccccgcgcccaccccttccgcccttcgccccccccttccccccagccccggtctcccgggcgcggcgtgagagcagagcccggcccggaggagccgccccttccccgcccgcccgcccggcgcctggagaggagcgcgctgaggatcgggacgcctgcggccgccgccaccgcccaggcccgtcgcgccccggccgggatggacccacacgcccgatgagccccgcgccggcggctgcgagcgccgagcctccccctgctgcggccccagccgccccccgcgcgcccggctccgcggaccaggacccctgggctccccggctgagggcgcggccgctccggagaggccgagcggggacgggcccgagatggcgcggggacccagcgctccggcggcgggcgccctgcacgcggcccgggcccggggacagccccggagctggtagccgcccggcaccgatggaccttgacccgcgaggcggcgccgcgctcgtgcccagctgcagctagaggggcgcgcgggcagaacgcgctccaggcccgggccggcccgcgcggccatgaagatgatgctggtgcgccggttccgcgtgctcatcctgatggtgttcctggtggcctgcgcgctgcacatcgccctggacctgctgcccaggctggagcgacgcggcgcgcggccctcgggggagcccggctgttcgtgcgcgcagcccgccgccgaggtggccgcgcccggctgggcccaggttcggggccgccccggggagcccccggccgcctcctccgccgccggcgacgcgggctggcccaacaagcacacgctccgcatcctgcaggacttcagctccgacccctcctccaacctctcgtcccactcgctggagaaactgccgcccgcggccgagccggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtcctgttcaatgtgaacagcgacaccaggctcagccccaaagcggcggagaacccg

SEQ ID NO: 10728 - DNA, 1287 bp, Homo sapiens
ccgtggctcggaagtggaccctgtccgacgcgggggtggtcgctggagggccgaggatgcctacacaggcccctggagggtgtgccttcggagtctgtctcgccctctggacccatgggggaccagcaacgccgtcacaccctcctctgtctctgccagccgctcccccgctcccttctcctggctgaggctggcaaaggcaggcaggcatgggggggcggggcctcaggagggaggaggggctggtgggcggggcctacggacacctcgccccgcccccagtggggctccgcactccccacaccccgcggtccccctaggtcagggcctctcaccaccgcgcccagaggccgggccagccgggcgtgcatcccaggggcgctccgtcccccgcggcctgggactctccagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggcccgcggggtatcagctgtattttcgaacccctgtgcttggccggggagttcccaaggctccactccgccttggagggggctgcggaagcccggaggtgacccgggctctgggaggggcgtccccaacgtgggggaagggagacaggggccttcgaagacagcgcgagactcggagggggtccccccgacctaagacgtggtaaactgaggccggcgaggagcgaggctgagtccggggaccaggcggcccctcactgctcctccggcccgtcgcccccctgcgcctgttcgtacgggcagggccggcggccgagtccagcgggctcggggccaggcctgggccccgggggcggcgcctcctcctccgcgccgtccccatgctcgccctccgcgtcgctctcgtccgagttgtcctcctccaagtagccgtcaccgcgcaccttgtgctggggccgcgggatgcggggctggcgcggggccacgccccgccgcagcttctgctccatccgcaggtaggagaccgcggccaccaccagcgtcaccagcagcaccgccagcttagcctgggcgtaaggagagggatgccagggacccgcggccgcctcgccccgcaccttctccgcctatacccctcgctgagataggcccttccctcctccgggagcctcccgggccacgcg

SEQ ID NO: 10729 - DNA, 2906 bp, Homo sapiens; identical to SEQ ID NO: 5279

SEQ ID NO: 10730 - DNA, 2146 bp, Homo sapiens
tcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcg

SEQ ID NO: 10731 - DNA, 865 bp, Homo sapiens
gcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgcgggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccggcgcggggagggcccaggcgcagtcggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccg

SEQ ID NO: 10732 - DNA, 865 bp, Homo sapiens; identical to SEQ ID NO: 10731

SEQ ID NO: 10733 - DNA, 1463 bp, Homo sapiens
tcggggggccgcgggacgctcaggaagcgaagcggggaaggctccgggcgcgtcgcaggacccgcgctggagatgggtttgaagccctgtcctgaaaaagccggcccggagtgggctgtccccggtgtccctcgagttctcatgctgtcattcaagcagcagaggaagaaccgggtctggctcgggaagggtgggcttagggccaggggtgcaaatccctcggtaaaagccggcaaactaaaagtcgcacacatcccaggtcccggtccaggccccggcggggcagggtccccgaagtcccggggcgcgcagacgccggggcccccgggggccaagggaacggcgggacccgacctccctgccctcggcctcccgggccctcgccctccgaccagccgctgagtcgggggctggggtcgccgcttccgcccgcggcccgctgcccctccccggcgcgcgccatccggccgccggcccctcctcccgcggggggctccgtcccgcgccccgtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtactgggcggctcggtgtggtggcgggggcgacgcgggacccagtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcg

SEQ ID NO: 10734 - DNA, 1437 bp, Homo sapiens
tcgcaggaaccgaggagccggccggcccaggcctccaaggtcacggggagggggtcagggcggaaaaggcagtggagtgagggtgccgccctcgggccgtgctaatcccgctccgctccgtgccgccgaggcggggtcctggccacgcaggaggtgcgcctcggaggagggcggcgagcggctacggggtggggagcaaggggcgcgcgggcggcaggcatggaacggacgcggcgcatctcgcccaccgcgggacgcccggacggcggccggcgcgcgcggcccgcctcgagcccgagagggcggggagacaatgcctgtccggcggggcagtccaggccgcacgctcccgcccgcggacacgggccgctcctacccgggcgagagggcagcggcgggaaggcgccgggagcgatggccaccccggccccgcgaggcgcggcaggccccgctcgccctctcccgcgcccgcctggcgtgcgcttcacccggcaagtcccggggccacagacccacctcctcctccagggcgccgccggagcccgcgccggagccggtgccggtgctgccgccgtgctcgccgtccggcttcaggttgctcatggtgcgggggagggggcggcgggaaggaacgcgagggcgagcgcggcgccggccccgcgggaagtgggaaggggcgcggggagcggtgcgctcgcgggtgcggagcgggtggcgggggacccacggggcagtgagaggggcagcctccgcgtcgggccagggtcacatcaagtttggcgggtgcggaaggtggggagggggtgcggcgggggaggcagtgggagccggaggggccgccgcctccgccttttcactgcgaccggcgagtgcgccgcggcggcggcggcggcggcagcggcggcggggggcgggcgccgggggagggggcgggcgccggcggcggggggcggggccggaaccggcctcagctggggcccggccagccccctcccccgcccgccgcgcggtctccgggggaacgcgcagccaatccccaccgcccaccgtgggctcgccccggccccggccgcggggcgccggcctccggccgggcctttcccctctctctcgcctgggtcagcgctctccctctctcctcttcccccgcgcccttctccacggcgagtttttaaactttgatgaactcgcccggcgaactttcttaaaggggccgcgcgctgcgcgccccagcccgcgggaggtggagccccgtgccccgcacccagcgccccggtccctgggcggccctgcccgggcggcctcgcgcttagggcacccgcagcgaggtttccgggccgtcgactccccttgtatcttgatctagggttttggggttcccgacgcactcattctgcccctaaatccagtcgcgcagacctcagctccgggggaccg

SEQ ID NO: 10735 - DNA, 717 bp, Homo sapiens
gcggcaggggcgggacccggaggcggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccggctctgcaacagctaggcgaggcacatggggtcagcacgcccgcggtccccgtgcaggccgctgcgattcagggatcaagtccagggtcacccttcaccacccatccgggaagcaggctcacccctgtgaagaaggccatagccgtgagacgctgcgggtcgtccgcgctgcgaagccgagggagcaagtctgcgaagaggcctcgcaggtggtggtcggcatgtgccaccatagcactggggtgggtggaaatgggagctctcgctccgtttggcggcctttctcctcg

SEQ ID NO: 10736 - DNA, 1713 bp, Homo sapiens
gcgctgcagactcgggtttccttctcagtctacgcgcaagccgggttcggcccacacccaccacacccctccggtccccgcccagcgccgctcctcctcccgggcttctccagcaccgactcagcacctatcagcgccgcccccaggcccctggcccagcccatcctcgggcacgtgtgagtgtgtgtttgtgtcagtctgtcagtcccaccggggaccgggctcgcttaccgagagagaagcgctaacttctgctccagcatcatctccagcttctggccctgtttggagatccagtggtccactccgtgcaggcggtagcacgtctccagcatcaacctgaagtccgccacgaactcggtgatgcccccgtactggccgctggcgaacttctcttccatctgcagcagacacatgccctgtccgggctgctgcgggaaggcgcgaccgccccggcccccgctgcgcggcccttccgccacctcctcctccgcggtggcaacgccccccaagggctgcagaaagggggcggtgaggccccggtgcttctcctgcaggaactcgcccaggatgcggtagccctgctgtagctcgtaggtcagctcctgctccttgcagcaaccgcctccgatcaccatcgcctccatctcttcctcctgatcgtccgcgtcctccagcgaggaggcactccttccgtgggccggccctgaggtctgggccgccgctgccacctcctcctcgtcgtcctctccttcggccgccggtggcggccgctcttcctccccagccggctccatcgctcccggcgtcccgggcacactcatgccccggcaggcctaggctgggcggtgtggaacagccgctcgaggtgctgggggacgcgtgagcgcgagccgcttcctcacggctcggccgcggcgcgtagcccccgccacatcgggcctggctctcctcagccgccggctcggctcggtgcgcgcgggggtcttgagctcaccgccggcggggcggggttacatggcgcgcgaggaggggggagagaagaggagagcctaggtgccctcctctcccctcccccccggcggcggcgcgcgcacggccctcgccggcctcacccctccgcaccccgcccgcctgctcttcaccggccaggccctgccgggtcgccgcggcctcggcgccccaccccctcccgggccagcggggggctgggagggggcgaggaggaagggggttctcctctcccctccccggagggggccgcagcggcggctccggctcctcctctccctcacaccccctcccgcccccctctacctgcgggggacacgggcagaaggaggcggtgcacggacggggcccggcgacaactgtcagttagaagccccgctgggcggtgaggggggagaaaggggaggggcagggagagaagggggagggcactcagccccccggctgggaagagctgtggagagaagcaaagaaagaggccctgtcgccatccccggtgcgcatgcgtagtagaacaattcccccctccccccccgccaccatcgtgccccgccccgctacgcaaaaggaagagcttcggctcagctacaggcccagaagcctgctagggttgcgcggaccaatgatgtaatcaatcgtaggccaatcgaacatgttgatggagggggaagcaaggcgcctgcgcagcttaattcgctaccg

SEQ ID NO: 10737 - DNA, 699 bp, Homo sapiens
gcgcgctcggaaagccggcttgggtcctgctaattattctgaaggcaaagtacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtctcgctcgcactcacaggcacacaccccacgtctccagcagctgccgctcggcctcacgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcacgattccagggatccagggtaaagcggttcgcgcg

SEQ ID NO: 10738 - DNA, 1191 bp, Homo sapiens
tcgacctccaccaagcggatggccaagcgccacccggaagtgtccactggtgggggcgggaaggcaccgtagtccaaggtatccgcgggcagggagcgggccagggcgtgcgcgaggtcgggggtagctgggaacggaggaggaggggcccgctcgaggctccgcctctcaccggctgcggcctcggctacagccagggcccagagggctccgagtcccgggagcggaggccggagtcgggttcctgtagaggctgctcctccttgtccccgctcggacgtggtccccgctgctcgaggtgcagctgcagcagggcccggcggtacatggcttccagcttctcaagtcgggccctcagggccctggggctgcccggctcgtcctctcggccgctgtctctagccctccggttcgtgctggcctcttcagggacccggcgtgcctccgcgggcgtcccgttgccgccttcgccggggagccgcaaagcctgacggaagaggctgcggttctcgcgcttcagccgccggttctcgagccgcagccgggcgttctcctgacgcagccgcgcgttctgccggtcccactcgtcccgcgcacggatggcctccaagtggctcgccgccaggtcggcaaaccgctcctccagctgctgtcgggcgccgtccgcgcggcctcgccagcccacgccgccgccgccgccgctggggctgcccccaccacgagcccggccggagcggcctggccctcggccgtccgcagcaccgtccccgccgcagcaactcccgcgcctagtggcgccaccacgcatgcgccacatcggtcccatcccaaccgcgccgccagccccgtgggctgaggggccgcgcggccaggcgcgggcaagttcggggctggcagggcggccggggtgacgacggaggaggagaggaggtcgcgggcggcggctgctggcttagagccaaaggaggccgggaatttgcccagactgaggcgtgtcctgtctcctgtggtggagctgccccctgggcctgctctctccaggctgcgctgacacacagttcccccggggagtgctttgctgttcagccctccggctgcgcgggaaaaagcgtgtatcctcagctgagttgtgccagggcgcttccgtgcaggcctgggcactgcaggaactagccgtcctcgcccgctccg

SEQ ID NO: 10739 - DNA, 536 bp, Homo sapiens
ccgcctcctacgtgctcgcgggggggggcggggtcggtggactgggcgtgagttaattggctggggggcggggcaccacgggttggctccgcccaggcgctcgcgcggatcccgggtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccg

SEQ ID NO: 10740 - DNA, 728 bp, Homo sapiens
ccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgaggtgagcgcggagctggccgagaaggggcaaaggagcggggcggagcggggccagagacgtggccctctcctaccctcgtgtccttttcagatccacgtggttcacctcagcaccgcctttgccagagttgacgaggccttggggcgcccgggaggcctggccgtgttggccg

SEQ ID NO: 10741 - DNA, 1431 bp, Homo sapiens
tcggtcggtcctccctcccccaccccctgactccggccgctccacggaccgcagggactgtcctaccgctccccttcacgcaaccatcagagaatcctctcaaaaacacagacccgatgaggagtggcttccccgcctttcccctgtgccgagaagggatcccggtcgccaacaacaaagacgcttcccgctcccctccccccgccggcccgggctcgtccctcccgcgctgcggctcccggcctagcgccccctccccgagccgggctgcggcgtccccaaaccccgaggccgcacgcacctgcacctgagcggcccgggccgaagcgccgggcagaaggggtcgagagagaaccgcagccgacgcgctgtcctccacaaggcgagatccgcgctccgggcgccgtccgactctctccgcctgcagactggcccgacagaggagcggggaccagggctacagcccccggcgccggggcgaagaaggacggcggcgccccaggggccccgctcacgctcccgagtctcgcctcgcgccggccctgctcctccacaagagctcgcgttctgctgactaacggccccggtgcggggcgctggagcggccgccgctgcccgtcggttgctctcgggcctcacgtcccgcgcggccgtggtcgcagccgccgccgccaccgcctccctttctggcactgcagacgccacccagacctagccaggtcttccttctctttaatcctgctttctttgctcctcctcagcctgccaagcgcgaggctcgttccggtagcgggaggaagactggaggggaacggaggggacgagcacaatccccactgagccaggagttggccactgactggaggaaggtgccaaagctgaccccggctccagcctactagcgggcggggggagagacggagcccagccttgcctcacttccaccaatcagaggccgcccggcagggtgggaggcgctctgagctcaaggagaggctgagctcgctcagcaggaggcggggattgcggaaaagaagaaccaataggaacaaaggttccccgcccctttgatttgatggactacacattcgggccaatgggggaattctcatttcgaagaaagtgggacttgttctccgggtttgagaaagaggctgcgcggagccggaggggtcgaggctgcgccgcgtggagtggcttggcttaacagcagggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcg

SEQ ID NO: 10742 - DNA, 588 bp, Homo sapiens
ccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcg

SEQ ID NO: 10743 - DNA, 1203 bp, Homo sapiens
acgcccaaccctcgagtctgcacggtgcagtaccgtctattttgggtccagggtaacctgggtgcaaacgctcctgcgggcggaccgcggggtgggccccgggcacacaggaggatcagcagcagccggtcggtaggcggagcgctgccagaggcttgggcctcacaacaaccctcacaggaccaaaacaaacggcgagacgggctgcgcgcacaatagcatacccgggcggctagccgagtcgggggtctcggctcgcggctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcgaagcggcctcggcgctgccgggccaggggtgccgtcaccgtcactgtgcgcgcccagagccgcacacgcgctctgaggcagtgaggggcccggtactctccatccccagctcgtcgggcctcctcggccctccccgctcggggcgctgctgcgacggcgacggccgccgccctagaacccgcaccgccgcggccccgcgcttccccgcctcgcggcggcgcccaacgccctcgcgcgcgctacccgctcccgcgcgactggctgccctccgcgacgtccgcgcgccttgaaggccgcagcgccagccggctccctccgccggggaaaggagtgcggccagggcttggcgcccgcagctgggcagatcctcggccgctcctgaggcggggacgaagggcgcgacccgctgcggccacagcgggttacgggctgcgggctccgttctgggcctggggagcagattcgagccgaccacgccccgggctccaggccgctgggaggcggacttcagagaagcg

SEQ ID NO: 10744 - DNA, 5370 bp, Homo sapiens; identical to SEQ ID NO: 5329

SEQ ID NO: 10745 - DNA, 1691 bp, Homo sapiens
gcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcg

SEQ ID NO: 10746 - DNA, 1223 bp, Homo sapiens
gcgctgtcacggagactccggccgccggagaccccgccgcagcgaggccactgggctccccggtcgcggggcgggagcggcgccgacacggggtgccaggaggacccaccgggcggaggagggggcctgtctacccttccgcattttcctgggtctctctcccgggcggtgacgtgacgtgctgacggcgggcccgtgccggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccggtgagtcccgggtgccgccgcggccgcggggcctagtgcgcgcacagcggcctggtctcggcctggtcggcggcccgcaaggcgccctcccgcgctaggccgggcggcgtggcgcgcggcgccgagcaggccccgaggaggccgcagttaggcccggggaggagcccggctgccccgagcggcggcggaggcgcgctccgtaagcgggcgggggttgggggagggtcgcccggttgtgccggaggcggtcgaggggccccgggtcggctccgcggccgacctggggcaccgcgccggggtgaggcctggcgaggaggcgaaggctgcaggcgtgaggtgaaggccgcaggccggccgggccgattttcgctatgtaaatatcggtgagggggggggagggacgggggacaagatggcggcggctcggcgcctgctgcaggggacgatagagggggttgccgggagggggagccgccatcttggaggcggtgtctggagagaaaattccgctacagcccgtgagggggggtgggagagcgggcggcggcggcagcggcgccggtgacgggccccggaggcccggcgcggcggcgtgtgcgcgcggaggggcgtgctcgctccccgtggcggccattgcccttgccgccatgatgagcgctcgggctccaggcgctcggcggcagcgccaccttcctgccttgcctcccgcagccccgtgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccg

SEQ ID NO: 10747 - DNA, 1103 bp, Homo sapiens
acgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagggagggggcccgaggcgcccccggcccgccctcctcccggtcttcggatccgagccggtcctcgggaaagagcctgccaccgcgtccccgcagccaccctctccgcgtgcccggccctctccagtggcgggggcacgtgggcgcgcggggtgcgtggcaagccgcccctctccccacgcccgtccggccgtctcccgcgcgcgcgccccgcacacagcctccgtgcagtgggcagagcccggccccgcgcgcgccccgccccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcg

SEQ ID NO: 10748 - DNA, 616 bp, Homo sapiens
acggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcg

SEQ ID NO: 10749 - DNA, 206 bp, Homo sapiens
gcggcgggcggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcg

SEQ ID NO: 10750 - DNA, 1141 bp, Homo sapiens
ccgcagtctgggagcgcgcggccccggggatggggagggggccgggaggaggcgtgcggctctgggggcgcgcactgcgggagcgcgcggtggcgaggatagggcgggccggggttcgcggggcgaaggcgcgcggtgcccgggggagggcgggccggggcgcgcgggccggggcgggggcgcgcgggccggggcgggggcgcgcggggccggtcggcgcgcgggggcggcgggcgcggcgctgccaatcgcagacaaaggccgtcccagtgaatcatgtggtgccgggggaggaagtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgagtttcagagaggctcctggaggcgctcacctggcggggtggtccccgcggggcgcccgaggcaggggcgatggcagccgcgggggcgggtccggccctagggctgagagtgtagggagaaggcgccggctctggggtcgtccgaaccctgtcctgtttgcgggcatttgtcataggaaaccccctgccattcccaaaaggggcaaggagaaggcaggggagggctggaggccgccgctcactcgctgcccctggctccgcatcgtgcggtggattcggggcgcttctccgtgcgcagcgcgaagcagcagcgcctgcacacgccagttagtacg

SEQ ID NO: 10751 - DNA, 1819 bp, Homo sapiens
gcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcg

SEQ ID NO: 10752 - DNA, 1813 bp, Homo sapiens
gcgcccagtttcgagagcctatcacagctcacgtctgggcgcgcagtacccccccgacactgctcctgttgtgtcagatagtggcagtgttgagcccaggaatacgcgcggagcccgcggcgatccccgcggccgctcagtcttcgcggcggactccggcgcgcaggagccactgggccgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcgatggtggaagctttgggctggagggctgggagcttattgagtttcgcctaatctgatctaccccccctccgccccccgccttttgcaccctccctcggtcctgcagccggctggcggggctggcgggtttggcgttggtggagtggactcg

SEQ ID NO: 10753 - DNA, 1872 bp, Homo sapiens
gcgccttgccagtcaagtcgggcagccagggacccacggagcaaagacctaagcgggcatggctccgataaagagtgaggtccgtttcctccctgttgcttcgccagttactaaagatgagtgaggcggaaacacgacggtggggagcgcggggaatggaaaagccagaaggtctcgcaacaacccggtgtcacctgaatgtctgcaaaacgtgccggcaaaggcagccatgcccccaccccgaccctggcccagctgcccgggacacgcgccacgcggcggtcgttaacactcaggggacagacaacagtcacactgcactgacagcacgcagacaacaccggcgaggtgcacacccacacatccaacgacaggctccgccactgcgaggcggctgccaacctggagggaacagggaaagccagccgggtcccagcctccttcctccgaagcacgtttacctaaacgtcgcagtttgcgtccaggctgctcccgctccaccctaaagattatgtcaacgcaggaactgtgggtgcgcgcgggcggcccggcggggagcctccccttctgggtcccgtcggttttatttcgggagcgggagggggaggagggagggctggaggaggggaggggaatcccaaattaaaataaccctcagttatgaggacgttcggtggcatcggatattcacaccagcaacagtcacatcacattcgccttcgccagatggcggcgggttcaacttcccgggatctcgcaaactcaggctgtgcgcccgagcgcgcgccggagtgtgggcacgcgggcgggctggggactgcgggagcggcgcggcgcggcgcgagcccggggcgagaacgggggcgtggggttggggggcgccgggctcaccggttccggacgaggaggtctccgtccccggggagcggcaccgggcagtcccggctcagggtgacggcctcgcggaagttggggctcagccgggtcaccaccagcttctgcatggcttggggaatggcggagccctggaagtccaggaagtggcgggcgtacgacatgtccacgatggcccgggccccggtgggcaccagccgcagcatggcctgcgcctccgcccgctctctgcgccgacgctggccggggtcggcccccgcccgggccgctcggctcggctgtgctctgctcggctagggcgggcgggtccgcccctcctccggccggcgccctccccctggctccccccttccccgcgtcgcccgctcccgctccccccgcctccccggcgccggcgcagcccccgcgaacccgggcgcaccaccccgggtgtcccggcctggggaccgctgccgccccggccgctgctcctttaatctttttgttttggtttgaatctgctcggcgcagactggccaaggatcctctccgccctcccccttcctcctggcgcgggagaggcaccggatatccccaccctccccgagctctaaaagccggatttgactcctctcgggcaagggtggcgggggggacggcgggcaaggggggacgggggactcgcgcgtcccgcggtcgtctgcggccccgagccggcggcagccccgggcgtccccggagctgcgcggcggccggcgcaggcgcctccccttcccgtgcgaagcgttcacttccttgcaaggtggtacgaatcaaccccgagcgcggcccgggcggcggggcacgaccggggaccccgggcagggcggggagcccctgccgccgctgccgcacgcgcacccgtaccgaccgcggggcggggaaatgtccagtgcctcccgctccccaggctggtggcttcctgtccccggaaccccttgcgcgtgctttctgtccacg

SEQ ID NO: 10754 - DNA, 652 bp, Homo sapiens
tcgcagaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgagctggctggtgattcatcctcggcgaggggctcgcgtgtgggccacgtcgccgtctccaccgggaaagcg

SEQ ID NO: 10755 - DNA, 722 bp, Homo sapiens
gcgttcactcacggcgcgtgcagggccccaggcctagggagcgagcggggcgctatgggggccggagtctgggtccaggccgccctcctcctaacctcccttgggtccccccatcccgcggccctcttcggagcgtggctcaccgggcgtgaagagcgcgatggccttgaggcagccatactcggccgagtcgacctgcaggcggcccagcttgtccacctgctcctggaaggcgcgcacctggtccatgaaagccacggcgcgctcggcggccataggcgcggcgtggaggccggcggcggccagtagcggcgccgtgtgcaggggcagcgccgcctgcgccgcgttcagcacgaagagctcgctccagctcaggcgcagcagcgccacctggtcggccaccggcagctcggggaagaagggcgcgtggcgcgcccactccacggtgctgaagagcagccgcgccgccagctcgcacacgttgtcgatgcccagcaccgcgcccgccgcgccgccccctgcgccgaagcgtccggccgccgcagggtagggctcagcgcgcagcagctgcgcgatcagttcggacaccggctgccccgggaagaggtctccgccgctcgccactgccgccagcgccgagcccggggggctgcccgaggaggcggccacggcaccaggcagcgagtgcgggatgcggccgcgctgcaccgctgcgggaggcg

SEQ ID NO: 10756 - DNA, 858 bp, Homo sapiens
acgatcacgtcaccgtagaccagggtcacacgatagaccccgcccctactcaccgtcctgagtccgatcaaacagcacccacggcacacactagggtctccgtctctcacacacacacaccacaatgacgtcgtaaacaatagcactaaccaccatcgtccgcagctcccgcgtacagaggcctcaggctcccggctccacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccgaagaaggaactggagggccgggctgggaaggcctgaagcgggtacagcctttaggctggggagggtcgaggggagaactcggagcctgagtcgggcg

SEQ ID NO: 10757 - DNA, 598 bp, Homo sapiens
ccgaggttccggcgggtccccgcaccggccccagctcctcccccgcacctgcctggccggcgggtcccaccctctctcctgccaggggtagaccctgggaccactcagctcgctctcgcaggccctgagcgtctgacgcctgcgcactgagcgcgggcgggcgggcactcccagaaacctccggggcgctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaaggtaggagtgtccgggatgccggagcggacacgcgcggagaaagcgtcgctggggttactcgtgtggccgtgtctccg

SEQ ID NO: 10758 - DNA, 1281 bp, Homo sapiens
tcgaaagcccaaagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcg

SEQ ID NO: 10759 - DNA, 1788 bp, Homo sapiens
ccggccaggcccgccggccgctccagcccagcaccagggcgcccgcgcggctgccaaacacccccgggagttttgctcgcaaagggaccacgaggcagctgctggcgcgtcctgcgcgtacccgcccagaggctccccggcttgctcctcgcgggtctgtcccgaaactgacgtgaaaccgatttggtgcaatgcgaatgagctcccgcccgcctccgcctccatcccagccgccgccgccgcccgtcgccataacaaccggcccccaccccccccaccccacgccttgcccctcgggtcccccgggccacaggccacagcgcgggaaggcgccccgccctcggcgccccgcatccggccgccgcgcacccccgcccgcccggcgcttccgagccacgcagaggcgccccctcccgccggagacgggaaagccccggcgcccccagactgggctccgtttccagctcccggaggggctggggctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaacgtaagtggggaccggggaggcgagggtggaggtggccgcggcaggggctgcacgggcagctccagctgccgccgccgccactaccgcggcagaaacccagcctgtcaccgcgtcctcattgtcccgttctcggcgctgcggagcccccccgagcgcgcccgacgcgtgggcctgcgacccccgggtgggcgccgttcccgggagggggagggggcagcgccgggctgtcagggagcagcccacgcgggcgcgcgacttcccacttctcctgccaccgccgccctctccgctgccttctccccacgcgtgactgtgggctgagcatggtggggatggctgtttaccggctgtgtgcgtttactcgccgtgtgcatgggcgcaccgcgttggcgagacgtggtcacgagaagatcagcctccagtcgttcccatttctgtccttacatcatgtatttctatggaattggcatctgcacgtacgaggtgtaggcaagactttgggtggccacgcgaggatggaagggaagggcttcgcagtgctcagggtcacacgtgggcagagcctcaccggagggtctgtgcatttcacgcgggctcggccgcacgcgccggggagcgcgtctccaagggagggtctgtgcgcgtcgctgcgcgggcggtgctctctccgggctgcatcg

SEQ ID NO: 10760 - DNA, 626 bp, Homo sapiens
ccgttcggttctccgcgcagccgtgggatctcgaggagggcgtccattaggccgcgtgtgaccatgtaaggtaaacagggggctcatgaagtcactgaggaccaatggggagcccggagcagagcctggggcggggcttggccctggcggcgggcgcggattggcacgctgcggatctccctgctgccttacaaggcggtgcgaggcgagctatttttagagggctatataagggggctgaggcggccgcccggcggccgggcagcgcgagcgcaagggacagggagggtcgtggcgacactcgcgccagctcccgggacggctgggctcgggctggtcgccgacctccgaccctccactagatgcctggcagagcccggcgcgtccggagcccgcgcccctcagagggaaggggtcgcgcgtcgccgcggcggccctgaggctgacggtcgggaggtgaaaggccggagtgcggggtcaggacgcctcctggagggggcgcggcgcagggggccgcggggaagccgccgagggcgcggagcgggaaggaaggacagtggccaccccgcctccgcctgggcacggggcagggacccgcgcgaggcggtgccggggaggtcctcacg

SEQ ID NO: 10761 - DNA, 1037 bp, Homo sapiens
acgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttgggagaaacttggagggcagcggagaagcccgacgggcggctggaccttacggacggttttaggggcggcagagccgagaccttggaccaaatcaagggggactgttgctagcgggacgcggaagtcaggcccg

SEQ ID NO: 10762 - DNA, 977 bp, Homo sapiens
ccggacttgacggagcaatgcacgtgggcctttgactcgtaatacacccagtcaaagccggcctccactgccaagcgcgccagcagtccatacttattgcggtcgcggtctgatgtggtgatgtccaccgcgcggccctcataatgcagggactcctctgagtggtggccgtcctcgtcccagccctcggtcacccgcagcttcacaccgggccactggttcatcaccgagatagccagcgagttcaggcggtccttgcagcgctgggagaggaatgtgcgcgaaatcaaccagagcgaaatcagccggaggagccggccgaggtgcaggtgtaggcgcagcctcgcccagaactctcccgccacacccaagggagctggaagcccgggagggtgctgtccctctcccttaggaacagagggccctgaagtgctccctccctagcatacagccgcccccggggatctggaccgcacggcggtatcacaaatctggaggaggcatggaggcaagcgccctggcggcgccttcactggtaggtggaggtcccctctctcctgtgctgtcttcagctccgggtatccatccctccacagacaggactacacctttcagcgcccggtccctctgtgcctccaaggcaggagggccagccagcggccgggagggaggagtggcagcagagccgactgcctgcggccggcctgcgaggcgtgcaaggcccgaggtgcccagtaggtgtcaccgcagcctcagggctgaggcctggggacgacaggctctggaggcgcggcaggtgcagagcgtctcggtagcttcagggggtgtgttggaggggaatcgccggcctgcctggatccctcgagcaccaccgaggattcccgccgggaccctcttataatcttaaaccggcccacaaccccgccagagatgacagggccagggaaccagaaaccggcggattagcgccagggccg

SEQ ID NO: 10763 - DNA, 6206 bp, Homo sapiens
tcgtcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcgataccctctgcggggtgagaatgcgggcccgcccggctcctcccgtgaggccagggcctcctgttctcctagacaccccaaggagccaactcctccgcagaagttccccgcttctgctcttatttccaagcttcgcgctttctacaaactccctgttgccttgactttgatttccagccgtggtgagggtcagagtgaaccccggcgcgctccccgacggcatccccgcacaccaggataggagaaattggagggcctggggcctcgggctccgcagtcgtcggaggaagaacccaccgcggggtccgcaagggaaagtgaagaggcccgggatttttccaaagcgctggccaggaccccgaaggaaggggaggagtcacctgaagccggggaaggccccttgggtgctctgccttggatccttatgttcactgactttcgcgaagcccccctggaggggggcaaatccgcgctgtttcccccaacttaacttcacgcggcccattctccgaatcgcgtgcgccaaggccggcgtcgggggcgcactgtgatggcgctttgctcttcccaggcgaagacaaatatctcgacccgatgtccccatgcatgcgggtgcacaggttctgagaaaatcacgcagaaggcggctgcgatccacggcccgggctgggctacacctgcttggaggtcgctggtgtgtgcgtgcgcgcgtgcgcagcctaactccttccagccccgggtggtgaaattagtttccaatactagtacctttcaagtttccatttattttgactgtacccgtctgaaagcagatttcatttacgctagcaagactggaagccacaaataaagaaaaagaaacggattcattgaatctcagtatctcagtagcgtttaatagattcccttggctaaattcagagccctgtttgaattcactcacgcaggagttgttttgttttttttgttggtagaggtgccggtttcccatccccacggcttatttacaattatgggtgttgttatttttaaaggattcacaaggtgactaactctctgttatctgttgaatggaaggagtgttacatatgcaagaccgaatggggcaggccgagcccccgccctatgctattctacaatccagatgggattcgtgattagaaaataaaattggccaaagctgtctcggaatccttttcccacttctaatttcatcagcactattaatcagagctcaaaagagcaaggaaataacatcagttacttttagatagaaatatgtttataaattttagataaactcattttaagatttctaacttttggggagactagcactcaccacagcatttttaaaactagggtgagacttttcaaaatatatttcactatatgcattcttcccttttcagtgtgtgagttaaaatattacaaacataaaattatcaaatatctttcccttgattaaccaacctgattaaccccttaattaattaagcctaacaactgtccccatcacaacttatgactcatgtggactctatttttacatgtttaatttctacgccagggtattttcagagggaaaatccaaaacaattaaataccttcagtggaattaagcgtaagtaaaactcagcaaaatctgtctggtatacaaagctttgcagaaaaatgtttccttctctttcaataaagtgacattttcctcacagcatatgacattttatgtggcttggctatttgttccccagtgttggacgatcagggccactacgcactcgtggggttctctgccctgtcccccgaagattctgccttttgtgtttcctcggggctgggctggacagaggatggaggcaggcggcccagtctgggtccaaacggaacggcagcggaggtgggggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgcacgaggccgaccgcgcgtttcgggcttcggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccccgcccccacccaatcagcgcgcacaacttccccctcggctccggctcgcggattgaaccctcctgacatatttggggccattcttctcctttgttgctattttgctagcgacccgcgggtaatccccgcgcgggaggggggcgtgcattgtcgcgctgatggacgggcccatttggcggctccgcgccccccggaggagagacacaaagcccaggcacgtgcgcctccccatagagaagcagcagaccgtgaagggaggcggggccgggcgtgtgcctggaccgggcggggcggcggcgccgggcggggcgaccaggggcgcgcgcgggggccccgcgccctcaggtacatctgccgcacctaccgggcgacccccgagtcccggcccccttttggccgccccatcgccctcccaccctgccaggctgaggagctgcggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacg

SEQ ID NO: 10764 - DNA, 574 bp, Homo sapiens
gcgccctcctccttgttcgcgtcctcggccttctcgctggctcctgcccgagtccctagcccctctgcaccacaggtttctggggcttcgtcccggacccggccattttccaggctcggagtagtcgccgtggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggctccgccccacgcgcccccctctcggatgtgattcgccggggtctcccgcagccggggcgagcggcttggaagcccggaggaggggtacggaactgcccgatggggatgcgaccgcgggcgccagacgaactgtccccacattcgttggcgctggcg

SEQ ID NO: 10765 - DNA, 3438 bp, Homo sapiens
tcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgtcggagaagcggtcctccacgctgccgttgccgcccgccgccgtcgccgaggccgtcgcgtgcggcccgggcccggggtggctagtgggcagctgttgcgccgggctagcggcgctggacggcggcggcgacgcttggtgatgatggtgatggtgcgggtgagcgtgcgggcccagctcgtcgtgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgccgcgaccgcccggcccacggccggaaggcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccccggagggcagacggggagaccgaagcacaccgcactaggcatccagactgggcttgggagccgcgcaccctccctacccagatccaggatggctagaattaacgggttctttctgagacctcggctcaggcgccgaaaccggatagatcgcgaattcgctggacccggagacccgacccgcctcccgcgtcaccttcttctttctagctttgggcgcgcgcagcgaaaggcaggagaggcgcgcactgggtgagtgagtcccggccgctgtctgcgctggaccagcccgactgacctcgcgcgtaggggtcgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaataaaatgagtgtattttaactaaaacttaactcaatcttgtggggtggcaaattaaatgctggaagagcgcgtctacaaccctcttcgagaagcgtgctctccgcagaaatgagtcggccgcctggagagagagcctgggcggtgccgctgcgcagcccctgccagtagctgggggttggggactcgcaccttgtaaatgtcctcgtcttgtttgaacgcagtgagagcacactcgtttccagatcactcgggaccgggtgtctcggatctgtgcagactatgtatggctccggcctcaggcggccagggcgggacaagcacg

SEQ ID NO: 10766 - DNA, 4088 bp, Homo sapiens
acgcctcgagcaccgactccacagccacggccaccgctcctcggctcccgtgacaccggcgcgcctgctgcttcgagcaggggaggctttgcactcccatcgcacttttctcgtccgaagatacgaaactccgtccgggcgtcgcaaataattcgaattcggctctctgacacctacctcggcgggcgcgcgccgctgggagggcggggtgggtggctggaggtaaggaggcgcacagcaggggtaagcgccgccgtcgcacactttgcacgccgcccagggctacaccactcaccgaaaattgggaggcaggtctgggaggcggggttgagcgcccaccgccttgggcgcgcccgcgccccccgccatcgcggcccccgcgcccccggcccacgcccgcgcggtcccggcaccggcctgcacccccagggtgcgcggcggcccatttgggtgcgtccccggtgggccgatttttcgcgcttccccttcggtttataggggccgctgctatgggtcggtcctctgaagaggctggggcgtcatcggggccggttagaagctctgctccccggcggggacactcagtcgcgtcggcaccgcggagcgggctgcgtcaggtggctggccggcgcggcgctcccctgctctctggctccgggctgcggcgcggcggctggagcgagcccctgtcccggcgcggggcggcggcgggcggccggcaggcgctgccttgcgtgtgagtgcacctcactcacatgtaagtcggggagcgccggggcctcccgcggaagtgcgagtcgcccggcgcaggcaagagccgccgggtccgggacaaggcaggggcgcccgggcgccgctgccttgccccggggcgcctccgggcaccccccaattctctctcttttctcttctccattggcgtgcccaagagccaaaccaaggagcgcctgagggtaaacagactcctgccatccgcgcctttgcacttttctttttgagttgacatttcttggtgctttttggtttctcgctgttgttgggtgctttttggtttgttcttgtccctttttcgtttgctcatcctttttggcgctaactcttaggcagccagcccagcagcccgaagcccgggcagccgcgctccgcggccccggggcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgccgccgacgacgacgagggcgccgaggagggcgccgtcgggggcgccgaggagggcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttattcgtgttcgtgtgtgtgtgtggacacattttccttttcggttgctctgtcctttggttcgtgctcgcctcgctttttccacactcctgctctctggctctctgtgtctctcgctctttcgaaaattttcctaagtccgggcgcgcgctccctccccttccgcccaccccagcccctcggcggcgcccgcgggagggggaggaggcctcgggggcgccgggcgacgcggtccggggggtggagcgttggcgtcgtgcgaggggtcgtcactggcgcggagacgccccctctcccccctcggctcagccgggctgctgcccgagcccggggggtggggggcgtctccccggcccgtcccgtccccggccgggcgcgggcggagggaccccctccccgggctcccggggggccgcctccctccgccggctcccgccctcccagccgccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtaaaggtggtgcagtgggggggagggggcgcaagggagtcgtggcgccggagtcgggaggggggcggcgaggggaggagggagggcggttgccgctgggcgcgacttggtgcgtttcgggcaggaccgactgactgtgtgtgcgcggagcagacgtgtcccgggccaggccgggccg

SEQ ID NO: 10767 - DNA, 522 bp, Homo sapiens
ccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcg

SEQ ID NO: 10768 - DNA, 2260 bp, Homo sapiens
acgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatttcaggggccgaccaggggagggaggtgcccggggacggggagggaggagggctgccgggatgtgaaccggggaaggcagctggggctggagagcagcgcggaaagggggcccagggagctggaaagagggccaagaggagggcaaggaaggtggcgggcgacggggagaggaaagaaaaagggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgtgggcggccgccgactcggcgcttccccgccgcccgcccagggagtccctgcctggcaagctggggctcggggaaaagtccagcagcgagagggccgcgtgtcccgggacggttccaggggagcccgcgcggaaacgcggaccaggcgcttcggcccggatgccg

SEQ ID NO: 10769 - DNA, 1502 bp, Homo sapiens
ccgcgggacggagacagggagttgggaggaaacgcaacgcgcctcccaggcaacagactccgagctccggttcggaaacgctccgaggcagaagcaagggcttctaagggctccgcttcccagccttgggtccctactactaccttccccctagactcggtgagcccaggctgatggaccgtgcagtccagtttgagccagcccagcagccctcaatcgggcgggcagggaagaaggcctcctactgccgggaagaggccagcgcgctccaagttccccgcaaattccgcccttcccgcctggcacggttcccttgcaccgctgtgctccgctcccaggtttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggccgcgcgccgccgcagtcctgtcgcagcgcgtgccctggtccctccggaccgaaaaggccgaagccgtcccccgcgaccgaccccgcgcaactggctcgggtctgcacctagatggctgtgggccccacagggatggccgggcgggcccgttcggccgctacctcagggtcgccagtccccgcgcgcggccgcctcccgccaggaagggtggcgggcccggaaggccagagatgccccagtgcttcccgcgccgctacgcacctagctgcccgcgggtcccacatggctgcggccggagggtccgcaccaggaccgccgccgcctggggaagcgcttccctgtgggcagggcgcggcgggcagtgcggaagcccgaaagctaccggagcccggggcaggggcggcgcgatgcagaggcggcgttcgggggcccccagctgcctgcggctcggctacccagccgcgatcagagggggcgggggacgcaggaaccccggcgtccgggcggtgtgcagccgcagacctattccaagtttccacgtagttgcgagagcccaaaaactgtcacgtgcacgtcgctgctgagtgggaggaggtgtttgtcatcgcgttcaaaaggggcgtttcggtgtctcccgtcatgcaagcaaatggtatggctctcggccgcctttgaataaacgagtgcttcgaaccctttaccaggagggactaggcgcacaaccacctccgacactcctcgggcatgcgagaattcggctttccttagtggggcccatcaatgttgtccgggaggtaaagaaagtgatcggccaacggcctcagcgtgggttttctccttccctcgttcctccctccaacaaaggacgtacggagaacaagccccctagctcctacagatgaggagctcaggagtcgggcgaatatcaagtacttactgtgtgcttgcccctccactctggggaggctgggggtccgggagtgaagggggcagcgagaccgcgggctgctccacgctcaccgtcg

SEQ ID NO: 10770 - DNA, 510 bp, Homo sapiens
gcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacg

SEQ ID NO: 10771 - DNA, 940 bp, Homo sapiens
tcggggcgcaggcaggaggcactggaagcggaagcgagtggggagtccgggtagagggagtcgcccacctgaccggcttcgccccctccggggtttgctgcagctgagggccccggaccagcgattctagaagccggtccggggccgggcagtccaatagcttctcgcggatttccctccgctggcgcgcagcagcggcgcgtggattcgcgcgcgggctcgggacggcgcgagcccgggcagcgcgagcccctgcgcggcagggagtggcgcatgcgcgggcgtcctgcgagcccgctggggcgagccgagccgcggcggcgccgggagccgggcggcggagctgtgaagaagcaagcggcggcacgggagcagcggcgacggacaggtggcgagccttcgcccgcgccgccaggggctgctgggccacccgcggagcctcgcggtccagacgtggcgggggtggcggcggcatcccggacggcctgtgagggatgcgccgcccactgccccgcgccgcctgaccgtccccgcctcgactcgcggtgcgccacagccgggcccgcggccgtccccgccgcgttgtcgcccggtcgccgcgcccgcggggccgcgcccggcacggccatgtggacccccacggaggaggagaaatacggcgtaggtaggtgaggctcaggcctggccgtggcgggggttctgggggacgcgcccagctcccggccccgcctggattcgcatcctcgtgcccccgccactgcccgcaggctgcgcggcctcggcgcggggcgagcgcggggtgggggcaggtgcgggtgcgggtgcgggtgcgggggtgggcgcgggtctctgtgcagagagggcggcagggggcgctggcggtgcggccttggcaggtgcggcccgcgggaggggtgggcaaggcccgggcagttgcccg

SEQ ID NO: 10772 - DNA, 2718 bp, Homo sapiens
ccgccgttagttatgattcatgctccagcagcgctgggaagtgggccgagggaactgaggccggggtgggtgcggaggtggctctgacggggagcgccgatccaggatctggtccggaccctgagctcggcaggacctgtgcgcacgcaggtagcgtcgcgtcctcccccaggctgcgagaggttgctctgccatcaggccatggaccccgagccgcccgtgctgcgcgcgcgcgtgtgcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcggagcgcccgggccgccgccgcctgtcgcctgcgccccggctgggctccgggaccgcggggccgctcaggcacgcccgctcgggcgccgcgtcgccgtgggctcgacgccggggcgctccccgtgagccgggccgagggcggggccgcgcgaggaccccgggacctgcccccctccccccgcagccgcgtcgccgctcgctccgggcgcctcctgctctgcacttacacgctcggcagctgcggggagcccggcagccacgctctccggcgcgccgcccgcggagccaccacggccgagggccggctgctgggcgccgcggtccccggcgggcgcgcccgagcagcaggcggcgatgcgggcgccgaccccggctggggggcgcccgagctgccgcggctgcgccccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacg

SEQ ID NO: 10773 - DNA, 2661 bp, Homo sapiens
gcgcggccctgctccgcgctttctctagccagcacccacgtgtctctatttactctactcaggttaccagctctatcgcccgcagcgggccagaagacccgataaagcgccttccaccctgcaggactagtgcccggcttccgctgcttctccgcctttcttctgcgtagatttaaggcctgatccggtcccaaaccccaaataaaagttgtgggtttgtttccaagtgatggcggttggagaaaactagagttgggggcggtacagccagggtgtacccttgcggtgggtcggctcggcgcacccacagctcccagctgctagcccaggcgctggggccgcagggactgaaccccgcaccgcccccgcagcccgggtgcgcgccccatcggccggcctgctccccgcggcccggctcaccggtggtagggacggccccgcctgccccagcccacgcccgcctccccttcctcccgcctgtggctctgctcgtctccacctaagcctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaactgatccatttggaataagttaccctgcccctctacctcccatcctacacacacacacacacacacacacacacacacacacacacacactgcggaccgggggcccagctacgcacacaccccaaaacaaacgagggatctactcgggaccctcagccgggcggccgggcgccttcgttcccttcctccctctctgagtttcccagggacccgccacgcctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggtaactcaagggtgggggaggaaaggagagttggaagggttcgtgcagcaggacagcgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcgccctgccccgcaggtgagcggctgcgcctccccactgcttctcctcctcccgcgcctcgccggcgctgaaaagctacccacttgcgtcgcttctcctccctctcccctcccccgcctctagctctccttggctgcccgctggaggggaggcggggggtgagggggagtcggcgagaaggaggtggtgattgagggcttttttttctttttcttttcccagatcctgtaggacgagtcttggttttggggtgtgtgagtgtggtgtgtgcgcgcgcgcctggagggaaggatcaggcaacttggcgagagaaggaaggaccgggcgctgcttataacccaccgaaaggcacgctttgcccgcg

SEQ ID NO: 10774 - DNA, 801 bp, Homo sapiens
gcgaggaaaattgacgttctattcctccggatcctgctcgagaagctgggggactcgggtccggtgccgaggtgtggcccgagcctggcaccacccacgccggccgggtgaccccggccccttggggctcccgcgctccgtcagcaggcgacgctgggaggctggggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccgcccgggccctctaagctgccagccgcgcccgcctccgggctcctcgcccctcctcccgcgcgctcccctcctcagcggccgccggaccccctcagttcacttctcccagttaacgcgttcctcggacgctgctagtttgagcgcacaggcattgggcggggctcacgggggagccgcttaataaccg

SEQ ID NO: 10775 - DNA, 311 bp, Homo sapiens
tcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccg

SEQ ID NO: 10776 - DNA, 1048 bp, Homo sapiens
acgggagcaggccgggctgtccacgacggaagcctcgaccctggctggggctgtcggccgggcagcgcgggagagccagggccagagccggggccgggaaccctagtcccgccgcctacgcgggatgcagcgaccaccgcccgccgcccccgggccggcactcacctccgtggaggggcagcggcgccagcacctggccgcggacctcggccttgggggagtcaagcccgtagcgcccgcggtcgatgcgaaacgtgagcggggcgccgcggccgggctcctgcaccgtcacgttgatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagcgcgcgcgcgcggcctgcgcggggccgagcccgagcgcggccctcctggacgccgcggccccgccgctcgccgccctcacgtccactgcccgcctgtggggacgcgcccatgggccctcggcgagggcggcgtctcaggtcgcacgcgggcgtctcttcggggtcccaggagggttgtagaagcgtgccccctccatccccccgggtcggtcccaccgaatgggaggcgcctcgcaaggacgcggcgggggaggggaagggcggcacgggaggaagcgccccgaggagggtcagcggaacacaaagtccctctcgcgcggctgccgcctgaggcgcgtgtccgccgccgccccgcccccccgctggtctagcggcaacgcgcaggcctaaggcgcagtcccgccccgagcgcatgcgtgccagggcctgtccgctcccgcccgcctgcacgagggcccgggcagccgggtcagccgctggtgctggttgtttctctgtcaggcgtgatagccgcagggcgtggagcccgggagatttgcgaggacg

SEQ ID NO: 10777 - DNA, 301 bp, Homo sapiens
gcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccg

SEQ ID NO: 10778 - DNA, 1395 bp, Homo sapiens
gcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccg

SEQ ID NO: 10779 - DNA, 766 bp, Homo sapiens
tcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagcccaggtgctagtggagcctgggagggacacggtgcgaccgacataagacggggtcg

SEQ ID NO: 10780 - DNA, 691 bp, Homo sapiens
gcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatggtgagtgcgcggcggccagcgcgctcgcctcccgccctcgtcccggagcgcgcggcgggccggccaaccgcgggccgggcgtcgccggaggaggggacgggggagcagggcggggagcggggttaggcctgtcgggccacccctgggtctgggaaaagctggcggcgccacctcttcccggtctcggcgaggcccgagcacctacgggcggcggcgtgctctcctggccatgtcggagcctctgcccgcgttcttcgactgcttgttggggctctggctggggactcggaccccgcctctgcgggggctggtcgccg

SEQ ID NO: 10781 - DNA, 1024 bp, Homo sapiens
ccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcg

SEQ ID NO: 10782 - DNA, 1339 bp, Homo sapiens
ccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctcccgccgcgccctcccgcgctcgcgccgcgcgcccccgcctgcgcagccgctcccgcgccccagcacgcccggccggcgcgcgcgcccggcaccggctctacctccactccgcctcccgccggcccgcgaccaagcgcggccattgttcgcgacgcagctcccgccccctggcggctgccgggccccagcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcg

SEQ ID NO: 10783 - DNA, 2273 bp, Homo sapiens
acgcggtggcactggtggctgccggcagctgtcgtctgcagagtgggtgagaccgagtgtggcagatggcttggtccgcggtgctggaggggactggcggagcagaagcgccctggcgccgggtccttgctttcctggagctggggcttggggaatggggtcggtcattgcagggacagaggagagggcagggtaatgggtgcgcaggggtcccttccaaaggctgcgggtggccaggggtgtgcgggggcgctgaggtgcggtcgccgagagattctggcctccagggtggtcgggcctggcatggactctaggggatggtgcacacaccggaccggacgggcccctcccttacccccggatcccccggctgggcagcggccagggagaggggcgacctacgggggcgggtgtggggacgccggactacgcgtcaggagtcccagatgggcccagacccccattccccgccccgggccgcagtgacgtcagggcccggacgttcccggaacggcctcttgggggcgttccagccccacggacccgcagggagtccccgccgcaatttgcatggggctcatttgcatgaccccgccccgcgcgggagtcgggggcgccggcgactggaggagccactgtcaatccccaggggaaagtgggcgaggcgatttctgggccgctcacctcactccaccctccagctcgcgccgcacctggggccctcccccacctacgccccgccagggcggggccgcgggcgcagacactcgcgggcacacgcacgacgacgcgcacacgcggtcgcacgcggccccccgagccccctgcggcgactccgattcacccccgcgggtgcggggcgcggacccgcccggcccagctcctgctccccaggcgcttcctcctcccgcgacctgccccggccgcacccgcctccgctccagcacgcgacgctgcccggcgcgacccctgctcccccggcccagccccaccgctgccctcgactcaatcccagttgaacgcccgcagcctcagtcccacccccggcccagccccagcgcccccagtcccacccccggccccagcttcagcctcagcgcccccaggcccagccccagtcccacccccagtcccaacaccttcaggcccaccctcggccccagcctcagccaccccagccccagtcccggcccagccccagccccagcgctcccggccccgggcccagccccagccccagccccagccgagcacccccggccccgcctgcccggcgttcccttttgtgcggcgctctcccgtccgcatccgcccgatcctctggaactccccgcggacgccggggtccctggaggcggcttcctttgtctctgctcccgccctccctccgcggcgtcttcgcccctcactcacctccccagccccgcggggacgaggggagctggagggagcccgggacccggcgcggcctccgcaggcggcgctttcttctcgctcccgacgcggccgcccctcctgcctgcccgctcctatcgccgcttccgcctctgccggggacggggacagcagaccctcggcgcccggcccccgcgcacctgccgcgcgcaccgcctctccggcctgcgcggctccgggggctccgggaagaccgagcgctggcggccagcccggggaggctgtgggcagcaggggtggctgcgggctcccagtccctcctccgcctacctcggagcccacatttgggatttctactccgggagaattctgccctcctcccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactgtaggtggccgcgggcggggcgtcgcactggccaagccccaaccccgaggcccctgcacatagaggctggaggccgcggcgggtccgcggggctcccggcagcttcccggggatgggatgggtcactctgcggacccctcggtccctggaggccg

SEQ ID NO: 10784 - DNA, 5586 bp, Homo sapiens
gcgccggctgctggggctgccaggtgccaggagacgcctccctcgggcctgccccggcgcccgccctcaccggcgtctgtcctgccgcccagctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccggtgagtccgtggacggcggggatggggtccggcggcctccgggcccctctcaagccgcctcctccccctgcagggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgagggtgagtggggggccccggggtggggaggcccggctagtagggccgcagccaaccgcgctctcctcttcgcagagtgcgcgcgcaggatgaagaagtgcatcaggtgccaggtggtcgtcagcaagaaactgcgcccaggtgggtgaggctctgcgcccccaacacgcctcctgctcagctggtggcccgcgggtccccgtcccccaccccttccctcccacacttccgcccatggcccttccccaggttacaccccgccctcccaaggctcacacccggccccccagcccccagcccccagccccgcctgctccagatcacacccggcccacagccccgcctcaaggtaacaccctcctcccccatcacaccccagccccgctggatttcacggcccctcccagatcacactccctccatagccccaccccagatcacagcccacccagagcaccgcccccccatcacaccccggcccagctcacagcccacctgcagccctgactccagcccgcacaccaccttatgcctgatttccacggctcacctcctgcccgcacccgggccccacctctgcctccaaatcacccaccccgccagccccccttgcaggtcacaacccgtcccaggtgacaccccgcccccagcctcgcccccccgcagctccctgctccccgcattcccccacccggcctcccagctcacacccgtcccccaccccgcagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttgcctctgctgtctgcctgggggaccgggcgcctctggggtcctcccctcgggacacgcgggcgagcctgggggcgaggagggggggcccttccctgggtccgccccgcccgccccaggctctcgggtccagactcccgcccggactgcggccttcgggccaggacacccttcaggcgcgggcacggccgcctcccgccccccaggcccgggtccgacggggcggggactcctgtgtctgcccccgggcccccctcgctcttccgtcctgggggcggccgcggggactcgcgctctgatccaaggggcccgacactccccagggctgtggggtcccgtcccagcagggagttagttggggggcgtcccaggcagggtctgggggccgggcgcacgcaggcggggtgacgagctgggggggcggggggcggtgtcggagcaaatacggcggccaggcccagcctctcgcgctttccaagaaccgcccgcggccgccgccagctgcttggcgctgaccccgttggccgggctgccgtcaccctgggcccgacgccggcgcggaaaacggggagggacgagacagacacaggccggtctggctcggaatctcctgctcctctgcccaatcccccacccccgccccgcgggacgccggtgcccggtctcggtcccagcccagagccgctcgcgcctggacgccggccgccccgtcgaacctttgggtctccgagctccccgcccccgcccccaatcaggaccggtccagacctccaggcccggcgcttagctccgtttcccgtccctcccgtctccctctcccctttgctggggcctagccggggatttaggagccacacaccctccacctcacgcgctaccctccacggggcttcccgcagccagggcccgccccttcccggctccccgggagaccctggcaagttccctccctccgccccgcaacctggcaccctccgcggcccttgcctacccacgcaccccctccccgcctccccctccaccgccccatactcactgccacgtccccatccggccatcccctcccagctctcggggacactgtcaggcgagcgacgcgtctcctgcggcccagctcagctgcctgggccaggatggagactccgctcatgtggggctcaggggttttttgaggattccatttgggaaaaaagccaccagatcactcactgcccagcagtgggggcttggggacccccactgctaccctttcctaagcgggagccctggcgctgcccttcccgggctgcctggggccctcttcgctcccccctccgaggaccccgcccagcaggccatgcccaggcctctgcccctggcccacgggacgcgggtccccatgcccccggctggagacagcaggcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcaggtgagcggcgggggggaggccaggtgccgggttgggggggtcctcacgtctgtgggtctggtctatcggggggcccgcaggacgtgtgcggggtgtgcggggtgtttgagggtccggatgtgcgtcccgaggtcggagggttggacgcccctgtgtccagttgttgggaggggtgggaggcctcgccctgctgttcagccccttcccctccactgggccgcgttcccagggacgtgcaacagggcgctcaggttaggagacccgaaaccacaggcagacaggacccgccacgcccgctcccagccctgggcacccccacccccgtttccttccagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggtgcgccctggctgggccccgggggagggggcgcggccggcgcccgctgagctcactctccctgcaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacggtgatgcccacggggccgggacagggctgcgtgggagctgggccttggccatggtcggggctgagggggcactgacggggctctttcccccacccggagcagaattccccttccccacggtggccaccaccccaccgccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcggggggggctgtgcctgcaggagacgccccgcccccctgcagctggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccg

SEQ ID NO: 10785 - DNA, 1264 bp, Homo sapiens
gcgcggctcgggcgcagttccggcgcagtccccgcgccgagcggctccgcgccccgcaccagcctctgcccggctccgggtgacgtcgcatcctccgattggaccacgcggcctggggggcggggtctggtccggtgagctcaccgccgcgccccgccattggtccgggcggcgcactcgggcagtggcggggagaccgcggtacccggagccccgcgagtcgttccagctgcggcgagtggagctgagcgggcgcggggccgggctgggccgggccgggcggggccgggcggggcgcgggagccagtgagcggcggctcggcgcaagcctgacgagcaggagccgagctcagcaggtccgggtaggtgcgcggcggcgcggggctaggcggagggcgcgtgcggtcgagggcggcggccggcgggggcgcgcgcggggcgggggcggggccggggcgtggggacacgcgtgctcgcgggccgggggcgtggtgcgcggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggagtgggtgggagacacgcgtgtccatgccgcgagggtgtgtcgacgcccgagcctgcgtggggcccggggccgtgtgtctggagtggccgagggcgtgaggggcgcgcgtgtttgtgcgaggggcgtgtgcggcgggtgtgagccacgcgtgtctgggtgcgcgcgcgggccggatgagcttctggagtggtgcgaggacgcgcgcgtgtgtctgtgtcggagcgagggcggggacgagcgtgtcgggcgcgcgcgggcggggctggggcggcgtcggggcgcgcgggggcccggcccggccggcggcgagtgtgttggggcgctcggcttctcctcaacacgggtttttgggacccagtgccgcctccttcccgcggcggggcccgcggagctcccggtttccctgggcagacaggtgcgaggcgaggtgcgggcacagccctgcgctcctcagcgggtgcgggatcgggcgacgggggactgtctctaactacagaccaggggagcggagggacgctcgattcacccgcg

SEQ ID NO: 10786 - DNA, 716 bp, Homo sapiens
ccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcggatcggagccgccggggcgcgggcggcccaggtaagcgggccgggtgggtgggggtcgcgtccctccgtccctgtccccggtgcacacaggtgacagcgccggcagtgctcggccggagcctgctcggtcgccagccgggacccccggcgcggcgcccctggaggggcctgcgggtggggggtgcggtcctcacgccctttgcgtcccagtctcttggtctctctccccggagtcggggagtcggcaggtccggggcgagggctcagtgaggccggcggagggccgagtcccagcccgggagcgggagccggggacccggcgcgcagggcggaagctcccgcacaaaaggccggagtcccgcacatggatcgaattaaagctccggcggcgcccagcggtgaccccggcggccgccctgctcggctgcctgcggagggtcccgcgtttccggagcccgggggcgctccaggccccttttcctagccagggtcaggcaaggggagggacgggtcccggggctgctcctctctgggcctcacgcgcccgtcg

SEQ ID NO: 10787 - DNA, 619 bp, Homo sapiens
ccgtccgggactcggggggaggcgcgctgggtggtccggcagccgggggcgggcggtagcctgcaggcgtaattggcatgcacgccgttgtagctgagaccgcttaataaagcattacatatctcaccgcttccatatttcattacctcacgcggagcctgtgagagggccctaatgggagtcagctgtgtttttactttctgttgtcggccgggacgggtttctctgcggattctttgaaatgaaataatgtgatgcacgccgcgataagggccggcctgtaatgaggcccaggccgccgggcggctgctattgctccaggtgtcgcgtatttgggctgcgaggacaaggaggaggagggggcggcgccggaggatcgggggggagggggaagtcgcgaggggcagggggtgggagaaggcggagggaggaggcagggggcagggggcgggcggaagaggggaggaaggagggggcggcgggccgcggcaggccaggcgggagaagccggagacagagagaggacggggacagtggcggcctgcagagccctaggaacccgggttcaaatcctgcccgccagcgtgagagagcgtttgcccgcccaggcggtccaccg

SEQ ID NO: 10788 - DNA, 293 bp, Homo sapiens
gcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcg

SEQ ID NO: 10789 - DNA, 2748 bp, Homo sapiens
acggcagggggtccccgtgccctccgagaatccaagaacccgccccgcttctacgcggaaagctgggagaaaaactgcttttcctttatttccccctaccccccactcatccgcccctggagctccgctcgcagatacctccccctcccgagccagaaatagacacactatctctcccccacctccctccccgtgcgcacactcgctcccctcctcctgtttgctccccgccttccccttccctccttcctctgctcggagctgcagcctgcagcctcgactcgggctggctggctggctgagtgcggccggggcgctgcccggcagtgcggtgtccacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctgggtaagtcctgccgccccgccccgccccgcccctggctttctcctaaccagctgctggggaaggtgtggggaaagcgaagccccctccccttgcgccttcccggagggccctcctgttcacgatcaggctgtgatgggcattgcgcccagatgtgctgagctggcccacctccagatgcgcatggctcaagtgtaccttcttaaagacattacaggcgggaacccgggctcgactctggcctgcccgaggtgaggctggacaatgggatggggggtgagggggttacaggctctcagaaatagagccagaatcccaatatggcaaaacctgggactggtggaaacctccgttgtggtgtggcctgcgcttgacaggagcatcccgcattgcaaggggagcgtccagcgagagcccggatctagaggacagatgtgggagagcagatgtgagggctgattggccccggaacacagctgaggctccacttcctctgtggatcccgagtgggagcgcaagtcggatttccccgcggtgtgaggattctggctaaaagaagcgtctagggccgggggcgggcgggctgccagctgtgcgcatctgggcgcatgtccgatacctcagccccggctctggccccaacccctacacccgcaggtcttttagggcgtgtcgaaagctctgggcgttagcgccgagactcctgtttgaccgggaagcctttgccctgtggctaatggaagccgagcaggcgggaagggaggaacaaagcttgctcgagtggaggaagcgcgcagagctgttccattgttctccgtgcctgaagagtctatgcaaaaaaacccgaagcgggccccggaactgctctttctctccccggagagcccctgccctcagagaggaatagatctgggatgtgccggacgccaggcggccatgcctcgggaactggcacgggccctcttggggccacggaacaaggacggtggggcctggtgcccaggcgagctgctttggctgcgcggacttgttgcggtggctgggttgtgggtcctccggcgccgagggacccgagcttcctgggtacccggcaggctgcccgcccgctgggggctgggaaggggcgtgccaatgcgcgtgtgaaagggcggggccgagtgacgggcttggcgggtggggaacatgcaagagctcgccgggcggccctggagaatgcgaagccggaggagaccggttcg

SEQ ID NO: 10790 - DNA, 433 bp, Homo sapiens
ccgtcccggcgctcccaccgccgccgccgccgcccaatagagcccctggggcggtccccaccgacggtgcagcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctgtgagtactgcccgcctgtccccgcctggtcctgcgggctgctggctagcgcccagtcccg

SEQ ID NO: 10791 - DNA, 1376 bp, Homo sapiens
ccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcg

SEQ ID NO: 10792 - DNA, 3393 bp, Homo sapiens
gcgggtgcacagggagcgccaggactccagcgtcttgccggaccagacccacacgcccgaggtgatgcccaccactaggcacatgaagtacttgagcatgaagacggcgtagtcgggcctgcgtgcctggtcgggctgcaggtcccgcaggcacgggcagttgtgcgtggcctcccagcgcgggcggttgtgctgctcgtagaagaggcaggcgaccaccaccgcggcgggcacggtgtagagcacggtgaacaggcccaggcggatcatcagcttctccagcttgtgcgtcttggtggggccgtcctgttgcttgatgaccgagcggatgcggaagagggacacgaagccggccagcaggaacatggtgccgatgaagaggtagatgaccagcggcgccagcacgaagccgcgcaggttgtccaggctctggttgcccacgtagcagatgcccgccaccgggtcgccgtccaccgagctgagcgccagcaccgcgatggacttgacgctgggcacaagccacgcggccaggtggaagtactgcgagtagccggcgatggcttcgttgccccacttcataccggccgccaggaaccatgtgagcgacaagatcacccaccagatggagctggccatgccgaagaagtagaccagcaagaagaccacggtgcacagcgcggggccggtggtctcgtagcgcacgtgctgctccaccgcgcccagctcctcgtactcgccgcgcccgcccgggccgcccgcgcccgcgcccgccgcgcccgcgcccgccgccgcgccgcccgcgcccccagcgccccccgcgcccggcgcgccaccgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagggcccttccgcactcctttccgccgctccgggggtttgaaggcggctgcaggcgcgcgccacagtccgtaggtccgctctgctggccccgggtcgcgctcagccctcgcggcgcagagcggccgggcctcggctcatcgtcccgcgctcgctcgcctcctctccgcgcgcccgaccacttctccccgccgcgccgggcggcggtgactccgccggacagagagggcggaggcgccgcaagtttcctctggggccgcggtgcgcagtcaagatggctgggccgggccgcttgccgcgccgggtcagccctggcggccaccactcggcccccgggggctcatgcccgcccccaaggccaagccgccgccgccgccgccggagttggggacccgcctcggcccaggccgccgccctctttctccggcgtccgtccttcgtccgtccgccgccgggacagacggacccccgccgcctggaaaagtcagcgccgcgctccggccgcagtcgggcgaggtgcacacagtctccttcctgctggacacccaggagcaaatccagaccggaaggcggagcggacacctgagtggcgcggcccgcgcccagccgccgcctcctcctcggcgggagcagcgcccttagcccaacttcccggctccagccccgctcgcgccgcgctgccggctcatgaatatttatacagcgcggactcggtctccgcccccagccccgcgagccaatcgccgggcggtagggcggagtccacgcgctcccagggctcagccttccttaaggcagtccccgagtgtccgcactgctgtgcgcgctctctgcggatggagagttttggtaaccttgggattgaccgcagagacagagtgttggccatggctgtccccatggcgctgagtgcgtcggaggtcttggtccccttaccccgagtctgcccttggggacagggacggggtttggtgcagcgcgcgcctccccggcgcgtttcaaaccagccaagcccctgctgccaccctccgcaaatgtgggtgatctgcaggcggctggggtctcgtgctcctcggggcggcaggaaggtctcgcagcaggcgagcgccggggaggcctgccggggctcggcgctgcagaagacccgggaaagggtgtcctccttggggttctcagaacgatggtttctgagacttggagatgtggggggtgtggagtcattctaaactggggctggacccgggacggcccgggtgagatgccccggagcccagccttgggcgcgcgaggggcgcgggggacaaatgcccgccagagactctcctcccgcctccgctgcg

SEQ ID NO: 10793 - DNA, 1381 bp, Homo sapiens
ccgcggcagcgccagctgcacttctttccaaaaatcggaggaaggagtctgggggccaggtcggggcggtttgcaggtgtgaacacctcggaagcccctggcgtcctggcccccaagagcacacctgcggctgcccacgggttccacgccctgcgacagctattccgtggctccgggggcctcaagggcggctccccgcatcggggccccaggcagcggaacctccccccagggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccacccaaccccgcgcgggacccaccggaagctgtggctgcaccaggcccggctcaggaaggcgtccgaaagcaccacgatgaggcgtcggcagcggctcaggttcaccaagaggtcggcggagggctctgcgggagggcgggcgtcggcggcgcaggggcgggggcgggggagggcggggccggaggctcaggggcggtgccggacgcagagctctaagggaggggcggggcctgcggggtgggcgggtttttgaggcggggcctcgggtgggcggggatgggggcggagctcgatggtgggggtggggccccgggtgggacggagcatggggcggggcggggcgggccctccgggtgggcggggcacggggtggggcccgggataccagcgcgcggcaggaggtcgcggtcgtccaggaagagcttgtagccccgacgccgctccagctgcggctttaggatgaagttcacgaacttgcggtcctcggggcagtcgctgtaggagacgtaggcgtcgtagagcttcccgtctgcggacggcggccagtcaccccgatggctcccgaggcctcacaccagccctcggggtccccaacacccctaaccatctcccacgtgcacaggggcagacccgccccggactttaaccccagccgggccgcacagagcacccgggggctaacccctccccgccgcacgcctccaaagccgagctcagcagcgcactctcagggaggccgtggcgacccctcctcgcgcccacgcgggccccacgcaccgtttatctccacctccccatacgcgtcctggtaccagagcagcacgttgagacg

SEQ ID NO: 10794 - DNA, 493 bp, Homo sapiens
ccggacccgggggaaatggggtaccaacggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggaccactcaccgcggccggcggactggcgggtctccgacaggtgcgcacactcggcgcaggctgtcgctgagcccggaattctgcaccgggagaaacttttcagcccgcagagcaaccgcagggcagtggacgggggccgcgcgaggacaaacagcggcggcgggtgcaaagccccttctccaagccgcggggttggccgggaggtgccggctgcacaacggcgcccacgtgacccaggtgcagccccaggcgcgcccaagggcagctcg

SEQ ID NO: 10795 - DNA, 922 bp, Homo sapiens
tcgcgggcgctctgcagggatggagattgagagaggccagggacccggctcccttgggaaaacgcgcgggcgccctagctccccgctctgcggcatctcacctgcccccgaggaccatcgtcaagaagaggtttcgtcgtgtcactgacacctcaccccgcctcctcccgcgaggtgcctccgagcccccgaggacgcggaacgccggggctccccgccgggcaagcatcagcatccagaccccgcacgcagccctgcacccccacgccctccagggaacgccggcccgcccgtccccgggacctcccgtcccctaagccaaggccccccaagcccagtgcccgcgcgccacccctccctccgaccctgcggcgggacccccacccccgcacctctccgcggggctggctaagcctccagacctcctgcgctgcagccggctcggaaagccacccccaggtcatccccccgcgcgcgcgcggcggcggctacggtggcggcggctgcgatccgaacgggcccctccatgcaccgcgcagggcagaggagggagcggcgcctcgcacgccggggctggggcgctgggcagggcgggcgggcgtggggtcccgggtctcctcgcacctagccgcgcgagccgggctcccgggctcaggggaggggagctgaggggcggagtcaccggggcgcgcccccgcggctgcgctcctccccgccggggagcgcgggcacgtaactcggagggtgctgggccggcccggagcacgcgagcagcgggaggagggaccggggaatgactgacggaggcgggccgtagaggccgctgtgccccgccggcccgcacccggccggagtgtgcgcgcgcagcctgccagatcagcggcgggggcacgggccgtaccaagtgacggaggggggcacg

SEQ ID NO: 10796 - DNA, 719 bp, Homo sapiens
ccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcg

SEQ ID NO: 10797 - DNA, 958 bp, Homo sapiens
ccgcgctgtcagcatctcgcacagtccgcccgaaacaccagggaaggggttcgtaggtgtgggggtggggtggcgaggccaggcagcctggcgcgagggagagagccgaggcctgggccaggaaggcccttgggtgccgtgtgggcgcagagcccaggagagcgcactgccaggcccggacctccccgcccctaccccgggaagaggcccgttcgccgcagggggaaggcgggatcatagcacctcggaggagcggccggtccgggcatgcgggcggcggggcggggagggaggcttccggaaccccgagagagcacccgtgcctcgcgggccccgtgccccgtccccgggctccccttcctctaacgcaggggacccagcccggggcagtgccgggcactggcgctggcgccccgctcagccctgcgatccttctccgccccgcccctccccgctccgccccgcccctccccgctccgcccccgggccgccccgccccgcaggctcgccattcccgggcaggccccgccccctgtttccgctggcggcggcggcggcggcggtgccggagcgcgagcagagcggagacccccaggtcctgcgggcgcggtgagtgcggcccgggcggcgggcggcgaggcgggtctcgagagcgtgcggagtcgcgcggccttgagccggcgccgggcgggctgggcacccccaggccgagacccgagaagggggagcggccgggggcgcccacgggaggcagtgtgggcagggcggcggtgggacgagaggacgaggaacagagtaggcgccgtgcgggaagcgggccgggaaggggagggtgggtgcggggcccgggcaccgagcgaagtggggtcctccaggggatggctccgaggaagaccgtttcagaaagggagtaacccggggccggcaagggtttccgactgtgtgaccccgtgcaccg

SEQ ID NO: 10798 - DNA, 3843 bp, Homo sapiens
tcgtaactttgacgagaagggctcccccgctgaaagcccaactgcagagcgcccggagcgcgctgtgagtccgcaggaacgcggccgggccggggacgggagaaaggcgcggccgggaccctgcactgtgccgcgcggcgcttgcggctggaacttggcctggaacgcggtcttctcggctccagtttcccgcccaggccccgcccacccggccgccccgctggttcgcaccgctgctccggccaccgaggagcccaaagttggcggcgtcccgcggactccggcggagagcgcgagggagtcgcggccgactcctgtaccacgaagacaactggaggccggcgggggaggcgggccacgaggggctggggcgagggagctgggatgcgcgggcccggctcgccgggaaacaggttgccgcggagtcccgtcccctccccctctgcggtccccgccgcgacctgattcccgccctgcccggggagctaacccagccgcctccggggcgccctccttcttcctggattcccacggctggaccagagcccctctggcagccgggttaaaggctccttcagcaaggtcaaggcgcggccggctggcacctggggatttttttccagccgagcactggcttttcaatcgcattgttaaggatcatggcagcggcaggaaatccgaagggccccacaggtctgcgggagggaggatttattttacagcaaggaacagattcagacagatcggggatttcagtgggaggggacgagaggtttcaggacgctggaatgtggcaaaaacaaaacactccccacccatgcacatcaccatctcctgactgcgggctggggggaagggagttcagggccaatgtgtcccagacttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattccggatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagataactgcatttctataaaccctctctccacggttagggggtgggagggagttagagatcgggtgggggcttggcgcggtactgttgagggctctgcacccaactgagcagtaatacactcatccacatggacgcgggtgcataaatcgccttaacattttgccctgaaagcggagccaatttccaaagttaaggaccacgcagctgaatttccagtactttccaacctcgcctaggcgggggcaggcagagaaggggcgggcagcgggcagctaactcgcccgacccccccgccaagaaggactcactaggtgaaccccccgcccttcacccaagtagttggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcg

SEQ ID NO: 10799 - DNA, 384 bp, Homo sapiens
ccggaagtcggggggcgggctctcatagctactgcccgtcaccagctcgttattgtgctcatatagggtgacttgaccccgaggcggtggaggagggaacaaccccagagagcacatcttgccggttcgcaggacgtctgcagtcggcaaactcctggccggaacggcacagaccgcactcccgcaactcggttcccgggctagattcgtatgcggacgggtaccgcaagggacaaacggcgaggcggaactcaacggaagtgaagaaaagactaacgggaaagaaggacgagtacgcggtcccgggacagacctccaaagcttcttcctgcgccccctggcggccggagggggagcagcgcggacacgtcccccggccaaccg

SEQ ID NO: 10800 - DNA, 1432 bp, Homo sapiens
acgccctgcgcccccagtcggggcccctccacccggcgccggcgcgcagcatgccgggagttgcagtcctcgcgaggcaagttccgcctcgtccctgcttgggggaggaggttggagagccgccctgccggcctttgaattttgccgcgaaaagcgcgcgtggcggcccccggctccgcccctcgcaggacgcggtgccgcgtcaccctggtaaccgcctctcagccgccgctgattgggctgggccgcggggggcgggcgggggacgagacgcgggggctgctgccggcgctcgcgcctgtcagtcgggccagagcggagcagcgggcaggactgcctggccggctgctccgcggagaggctgcgcgcgccggccgggggaggcggacagccgggcccggcgcctgtggggcgcggcgcgcggcacccgggcctgagaccaggcgaggcgccggcgcgcgccagacggcgcgaggctgcggccccgggagcccccgcgcgccgcccggggccatgggcgcgtgagagcccagcgcgcgcggcccctgctgcggcttgcgagctcgcacacccggtgcacagtcccccgggccgtcctcgtgtccgtcctgcgccactgggatcggctgtttctcagcgccgaggcccccgaggctgcatccgagcttgcgtcgcccgctgccgccgccgccgccgctgccgccgccgctgttcgccggcttcccctccccccacacccggggctcagagcaggaggaggaggggccggtgcattctcgccgctgttctttgcaacctgcaggggccggtgtatgtccggcgaggagccggggccgctgcgggtgcgtgcaacccccgaaggagacaatccctccacctcggggcgaacccgggggctgcaagccgcgggcgggcgggcgagcgagaggaagcaacaaagacaggctgcagctggggctggcgaaaggggccgcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggcagcctctgccactcctgcatggctgcgacccgtcgagcggagcgtcgtggtagctgagacctggtgcccttcgacggcctggctgatccggtgagttgtgcggggcggggttctgcgctggagctgggggcaccccctggcgtccg

SEQ ID NO: 10801 - DNA, 325 bp, Homo sapiens
acgtcagcgaaggccgtctcggcgcatctcagacaatgagcgcagtgtgcaggagcgaggggttggcagaggccaggaagctcctggggccaggcgcggctccccacccccacgccagacaaagagcgcggggcctggggagctggcggccttcccgccacttggggcgcctggggggctctggggcgggggaggcgggggctttgtctaactccgccactgccaccaccggccaggccgcggcttggcaacccgtgaacaggaggcagggctgcagggcgtgagggatgatgacaaggaagccggaggagcagcggcggcagcg

SEQ ID NO: 10802 - DNA, 1242 bp, Homo sapiens
ccggccctggccccgcctcgcacgcgctggtgctacagctgtggtgcagacgcccttccgctgcgagggtgcggccgtctcggggcgagtgcttcccggcctgcaggaggcgaactcgggcttccccgggaggcgtccgtgggaacgcgcacctgcgagtccctgccggctgaggagccgaggtctgcgacctctgccgacctgagctcaggcgcagcagcgcagacctggccgccgtatcccctctggctgggatgcgggcccacgcgggaaaggctgaaaggtggggaacaccccggcggaaaggaaccctccctctctgctctgaaggaaagtttcccaacacagccatgttcttggtggtctccggtcccccatccccaagcccccagtcagcctcacactcatccgcttcagtagccgcggagtgggggcctccaaagaacccagctgcagagcaagtccggctgacgcagtgtgcgctgggggcggggctctggacgggggcggagccacggcgagagccgcggtgagggcggggcccgggtgggcggtgccctgagcggggctcctagtgggcggggctctggggtggcggccgttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagccgggagtggaggcggccgccctagggagggaggagcgcaggcgggggctgctcacgggcggagtactgcgcggcgaagggaacccccgaaggggctgaccgggtctcggggccgtgacaggcggcgaggcggtgggaggggagcgtgtgaattcacgccgggtccccgcgggcgacgcgagcgacgcgacctggactcctatccgggatattgtaaatagatctgcttgtgaggctcacgactgggagcctgtcactctgcccaagcccgacccggccccggcgcccgcccgcgtcctgcggaggtcccctgagccagcgcgcggctgcaggggtctcggggccgcatcccggaccagcgccagcggcgggagagcgttgtctgtgagcg

SEQ ID NO: 10803 - DNA, 1460 bp, Homo sapiens
ccggggcagtcgagccacccccccaaagccgacctccgggagagatctttagctggacgcctcccgccttttaggagcgatggctgcaactattccgtccgtccccacggggcgccttcccaacccttcggttggctcttcccttcgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggtcgctgaagcgcgcggcgagcacgaaggggaaaccgaagcgcgcgcggtactgcgcgttgagctcggccagccgcagccgctcgtccgcgcccaggctcctcaggcctgcgccgctctgttcccgctgcgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcg

SEQ ID NO: 10804 - DNA, 1064 bp, Homo sapiens
ccgcgcgattgaggcgctagcggcggagctggacggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccgaacaccgggaccatgcactcagccgggactcccgggttatcctcgcgccggacaggcaactccaccagctttcaaccaggaccgccaccgccgccccggctgctgctgctgctgctgcttctcctgtcactggtaagccgcgtcccggcacagcccgctgccttcggcagggcgttgctgtcccctggtctcgcgggggctgcaggggtccctgctgaggaggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcg

SEQ ID NO: 10805 - DNA, 622 bp, Homo sapiens
ccgccagttagacggtgtttctgccgcccctgccgtcacccgctgggtcccgtcccgctccaagcgcactcccggcccgcagggtgggaatacgaggattacagtgccccacgggcgggcgggccaggatcgcaacctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccggggggcggtgctgcggggagcagaggtccgtgctcccgagccgtcgcgcgtggacaccagccccggcccaggtgcgggtgggccccgacgggagcgcgtggcaggccg

SEQ ID NO: 10806 - DNA, 1622 bp, Homo sapiens
gcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgccgtcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccgcctgtgtcgcgggccccctccctggctctggcctctaaagcgcccccggcacagcttcccggcccttgcagcccggtggggccg

SEQ ID NO: 10807 - DNA, 324 bp, Homo sapiens
acgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcg

SEQ ID NO: 10808 - DNA, 1881 bp, Homo sapiens
ccggggccttccagtcccgccggggcgcttgctcctcggctgagctcgtccgcagcgcggccctcggctactggcgaggctgtgcggaaccagaaggtcgaccgcgcccgggcattccccgcgcgcctctgaccccagctcggctccccggaagccgcctgggcgacttcgcggcctaatacccggctctgcgaaatcgctcgcgcctccggcccggcctggagggccccgcaccatccgcgcgcgcgcgcgctcgcacaggatccggccaacaggcgccgggacccttggagcccgccttgttagaaacttgctacgcgcgccgccgcacatgcgccctaggcccctccggacgcaggcgccaccgacctcgcttccgccccgcgccccccggctgccccgccgcgactccgggccgcgagcgctgccgcacaggcgccctaggcccctcggggcacaggcgccgtcgatcccgcttccgccccgcgatcccggcacgccccacgtcccccgcacctcagacccgctttccccgactcccactggacagccggggaaaatggcgccttaaagcgttcgcacccaccttgccgaaatgcgcggcccagtgcacgggcgtccagccatagaaggagtcctcagaggccaggtgggcgtggggtgtctgctgcagcagcgagcagagcgtggccaggtccccgtcgcggcaggcgcggtgcagcgggaaacggagcgagagcagctcctcgctggagaagcccgcctctacgcccgcgcccgctcccgccgccgacatggtccgtcaccggagagcgcggggctcgctggcctagaggacgcgtcggggaggactcgagaagccgccgccgcagcacaaaggaacgagactagcgccgcggtcgcgtcccacaggctgccgagcggagcgcgcacagagggggcggggcggggcctggagcggccgggctgggggcggggcctggcccagaggacgccttgtgcagccgggcaggggtcggggcctggagccgcggacctctggagccgccgggcagggggcggggcttgagccggaggccgcctggagcagccgggcggagggcggggcttggagctgcggacgcctggagcggccggtaggtggcggggtctagcctagaggatgcctggagcagccgggtagggagcggagcctggaccagaggacgccagcagcagccgattaggaggcggggcatggggctgtcgacgtctggagcagccgggcattgggcttgggctagaggacgcctggggcggtgggcgcctggagtagccaggcagagggcggggcctggcttgggtccacgcctggggcggccgggggcggggcctggctggaattgacgcgtggagctccggtggagggggcggggcctggctgggccgctgcctacagcggcttccggggcttggaggtcacggggctcggaggtcacggggctcggaggtcacggggctggctgtgtggggggctcaggggcgtagagtggccaagcagcggtctgagcgggtcccggggcctccggcgcggtgggtctcggctgcgccccgggtgcggaccatgatgtttccagcctgggagccggtccgggcggggaatcccggctgccgggggcgcgggttgaggctctgcgggcccgcgcccagagcgggtgggagtcacgggtctcccggaggcccagtagcgcgcggtgaagttgtccagtaaaaatttatggagcgcctacggggagcagggattctcgttaaaatctgggaatcagcaagccctagttccttacagagcaggacagattcctcggttttgtccgagggacgccttcttcggaaccgagtgcg

SEQ ID NO: 10809 - DNA, 944 bp, Homo sapiens
ccgcgtggggcccagggaggcgcgggctgcgggggattgcgcaaggccggggtttctggaggccgaggccgcggtgttttccgcgaggttattatgagctgagtgttcctggcaggcgcccagggactttccgcccccctccccccgcggccccggcgggcgccggccagaccgccccgccctcccgccagctcggaacgccctgtacttcccctcccggctgctcggcgcccgccagcggccagaaactcccgccccgccttatgcaaccggggacttcgcgtccccgctgccgccccgcccccggcctagaggacgggtctggggggagggggcgtgtggcgacgctgccatccaccagggcccagccgccgcccctccgagttgggccggtgccccgcgcggccctgcagccctgcagcgttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgcttccagggctccgagccgcgcggcacctcctgcggctcgaggcggatctcctgcagctccttgaccatctgctcgtactcctcgtctttcatggagtccaggccgctgtcgtggcggtcgtccagtagccgctccttcttcagcccgtcgcgggggccctccatggcccactcctgggggcgctcggccgcctggaacatggcgcggacgagctgcgggcgctgctgcgggtgcgctgggccgcgggctgcgcgctgcttcctcgctggggcgctggcgggcgggacggcggcacggactgctgtgggctctgcagcgccgccgcggcgccctataaacg

SEQ ID NO: 10810 - DNA, 1514 bp, Homo sapiens
tcggcggcgccccctccatccagcgtgaaacccacgaggcgcggcgtctcgagtggcgggcgggcagggggctgcaggattcacgaagccacctccgccggggaccgccttctctcggagtggcctcccctccggcgttccgctttagtaagacgacactcaggccaaacagccgcccccggccagcccgactcggctctggagggagcgccccgagggagtccagccggaggcggagaaggccactcggccagaaggtggggagccgccggcgtcccctcgcacctccgtctccacagcagggggaaaggccctgatcgccgtggtccacaccaccgcgtccacctgaggctcgcctcgcttcctgggtccctagaggggtggcgtactccgctttctcctgcccccaagtggccgcacccctccgcgggacgcttggttgggtccagggcggggcgggcgggcgctccccgtactgccgcgagctcagcgcgcagctcccgcggctcggctgccgccgcggccagttggggcgggtcgggggcggggtctcagggggcggggattcgggggggcgggtcgggtcgggaggcgtgggtggggggcggggcggacgcggagcgcccctctggctggcggggccaaggggctgagaggagtggggcaggctcggcgccggtaggaagagtcagaggggtgaccagagagcccaacgcctggtgctcaagactttctccgaggtatgaacaagaaccaggcgtctgggccctttccgctcgccccatcgctcagccgccgcgccccggacgcccgctgtgccccctgccggcggggcggcggcgggactgggtttcgggagggtttctggaagtcgcgagtcccagcgaaggcagtgcaccgctctccgcctctttcttcgccttcttctcgctcccttagctctgggtgtcgggcaccggtggtaaggtcgcttctccgtgagtcggaggtcgctcactctgggacgggcggacgaggccctagggcagccgagcccggcagcgggggaggcgtggagctcggggcggcttcagcggcgggggcgggaggctggtcctggctgcagactgcgcgcctgggctccgtgcgcggtccctggttctctgcatcgcggaggtccccggatcacagggctccctggcgggccccggcacccaggtctgtgtcgctgtggctgggcgccgggactagcacccgagtcccgcgctcccgggggctgcgccgtgccgcctgttgtgcgcgcgcagaggccggacagcccggctgcgggaagggacccgagcgcagggtctgccccgcgtcccggaaagtgcctagtctgcggagccggaggttgagctggggcagatcggcgccagacgggggcctgggtgagatacgagttgggggtgcggcctgcagaatttgggtttctggaggagcttacggcgcgctggcggagccccaggcgaacaggagcaccggattcggctccg

SEQ ID NO: 10811 - DNA, 2144 bp, Homo sapiens
gcgtcgtttccccttcgcgctcttcgaatgtcaagtgcaccagcttccaatccctcctctgggcgggcccggtctggctaatctcagctgcagattccagtacaaactcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaaggcccgcgccgcttcccactcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctccagccttctgggggcagaggacatcgggtgggggcgtgggtaggggaaggctctctaggcgctgcgcctggcttcgaacccccttctgagccgggtcaacttgaacccgcttcttcggcgcggacacccagcttccccggagttctctgggttgaggagaggtctcgcactgtacgcgtctctcactcccaaccttagggtccgccaccacgggtaggtgggcagtgtcagcgcccgaacttggcgatacccttgcatgaagtcagcctcgcgacatctaagcgggcagggaaacaaaggcagtgtggcacagcgggggcggcggcggggctgcgggggcccttggcgctctggggacccgggcgggggcgtgcggagccgcagccgccctgcagggggcgatcctgtcgccgtctccgtccgagccccaggtgacagagctgtgcgtggccaggcaggggcacctgttgaggcgggaggctttggcacccgccgagagtgcgctcgagcgggcgcattcttccagacgggggcggttggtggacgagagcctcggacgaccctcgggaactaccagggcggggcagcctggccggatgaggaccaggaagaggagagccgagtggggcgggggtaaaggagtgaggaagcgtggcgattccgacaaggaaagatctgggcctgggggtggaggggtgaggagatccgcgggggaggtgcaaggtccggagggctgaggcttgtgtggagccgaatccgagaaacgcatccagacgcg

SEQ ID NO: 10812 - DNA, 379 bp, Homo sapiens
ccgcccggcggggcgccctcacgctgtgttctctgcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggtgagtgcggtcctgccccggcccccggaggaacctgcaggggagtcgggggcggggacgcgcgggcccgcaggcaacgtccccaggaaaggggcgatgtcagggaagctgggctgggaggaggcgagcccgcaccg

SEQ ID NO: 10813 - DNA, 637 bp, Homo sapiens
ccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcaggtaagcccagcccggtgctttccaggaagtccgtctgcgggcgcgggtagggagtcgcaccggccatggtggctgaggagggagaggttgctgcccgccggccgcccgactccaggctccttcccgacgggtccgtctcggggagcaggggtgcgcgggggctgcttctgcgcgaacggcccgggcgggggacgtggggcgcgctgggcgtcgcccgccggtctaggcgcgcgaacctggcgttcccagtgaatcacccgcggcccgggcgcccgggttcgggaccggccccctcccctcccgctgagccgcggccgagctggctccctgcaccctacccagcgtcgccgggacgcgatcacaccgagatggcaccgagcctccttcaaaggcttcggcttgttgaaagtggggcggcg

SEQ ID NO: 10814 - DNA, 959 bp, Homo sapiens
ccgcgggatcggggggatggtcgaccctcagatacgggagggattgagcgatgcccaaggagagcaggagaacactgcgcttggagacccctgagagccaggggcgggccgccccctaaagggaccccggagtcccgactctcagctccagctcttcctgtgacaccaccctccggacagagacccaagctccaggcccggccccgcccagaggttccagggagaagaccaggccaccgcccactgcccggcgtcggggaggaaagaggaggagcctctgtgtgcccacatctctggccgcccagggcagctcggctcggtctcgcaaccccagcccactggttcgggagacctcaaaggctccaccgccagcgcccccagcgctcactgtgtgcgccccaccccagccctgcctgcgcgccgctcccgccaccctcgcctcagtctctgggccggaagccccctctcctcccccgccgcagccccctcctagtccctctccctccgccgatgcgggaaaccttctccgccccgtcccgccctcttcctccagttgcatctccgcccggctcctccgtccagtctccaacccaggccccgcccctccccacccatttcccgccctgggccgggcccccggccccaccgccccctccccggccccgccccggcccccggaagcctcaccccgcccccggccccgcccccccgaagtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggtgagggcggggcccggcggggcgttgggctggggtcctcgagcccctcacggggattgcggtcctgggctcaggccctcgttcctgcccgccccactcccg

SEQ ID NO: 10815 - DNA, 826 bp, Homo sapiens
ccggccgccagccctgggagcctcggttgggcgacgaagctgcgggctggggcaccggctgcctccacgggccggttctgactcaggggctcggcccggagctgcttccccggcggcggggctgactcaaccccctctgcccgaggagttgtcgcgcgcagtcagcgccccgaactcgcgcgcggcccggcgccccctcggggcccacctcccgggccagccgccgcgcctacctgtgcccgcggctcggctcctcctcgctcgcgctgccccagccggggctgaggtaccgggccgggtccccggcgccccgagtctccgccccctcctcctcgtcctccaactcgtccacgtcctcggcctcctggatggcgacgcggatctgcaccgccgtcttgggcccgggccgagcctccccgccggactgggccatggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgcggcgccccgccccgcgccgccgccgccgccgccgccgccgccaccaccccgaccgctagtggagcgcccgcgcaggcggggcctcggaggtggagggcggctttccggagctcctccgacggaggcccgtcccggaaggatccccgcgacccccgatcactccctccgtcttttcgccgctgtggggccccagcccgagaggaggtgtcagggctccctcctcctgcgccttctttcacggcgccgcagggatgggcg

SEQ ID NO: 10816 - DNA, 2156 bp, Homo sapiens
ccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccccgcccccgcggggaacaatgggcgccggccggagaggctctgcggccgcggcgctcagggaaccgctccggagtgcagagcgcacggcccgcgcgggtcccgggcgtgcgtcccgcgggagggctggctgtccgtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaagccgccgcagctcgcgggttgccataggagcggctccagcagccgggcctgcctacctgggcttcttaaaggggcagcggcgcacgggccgggggctggaaaggggcggggggcgggcctggcaaggggcccaggttagaccctcgctagaccttcggggccggggtgagaggtatccacactgctgcgcccttaaatctctttcctgggctaagctgggagtgcgccccaagtctgaagctccggcttcagttgcgaattccccatcctaagattgaagggtggggggtggcttcccaatttctccatcaccaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacccagcccttcgaggtaagacttcgaggaaatgcgccggcaacagtgacggatgcgagatccgaacgccgacctccgcacgcgcctctccctcggtagttccgagaaagggacaagccggctgcagcggggagcggttgggccggttcctcggacg

SEQ ID NO: 10817 - DNA, 1441 bp, Homo sapiens
ccggagggaggaaccaccgtaagcggagactccgggcggcggccggcggaagggctgggcgggaggcgtcgggatgccggcaggaccctgcgcccgagggggtagggggctcgtgtcggggttccaggcgcagattgatggggcctaagcagggaatgtgagggcggggagggcgtacaacggaagggactaatctcgcggtttcgagttgggagcaaacctcgccccccaccccccccatccgtttccctttctcagtgaagacggtttgggggcgggtggggaggcgcgtcctcggagcgccctcgcgctcccttttcgctccccgcgcgcgatccatcgcctctcttcccccgaggccagcgatggctcgggtgcgggcgaggagctgggagggcggctctcgacgcaggtgtcagatccgctcggcagtgctcggcgcgctggcccggcccccagctcctccggccgccgccccccgcccgccgcgccgcggcgccaggagggcggggccggggcgcgcgccgctcctcagcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgagcggtacgaccgctgttgccctcgggtgtagagcagtgaggcgaaggcgcgccctcccgagtgggcgagttcagcggaatggatcccccgattagcgggggctgggccggggaggggaccggcccgagcgcgcccggggtccggggctagttgaggccggtggtcgccgctccgcggagtcggtggggagcgaggcggggcccggccttcgcgcgtgtgccgggaggcgccggcccgtggcgtgtgcgtgcgaccgggcgagccgtgtcgagggggcggcgacttcgggcgtgtaaggagtatggtttccccgccggcgagggggtgtggtaaccccgggaacgccggctggagtcggacccgcgggctgctgacctgtcctcgggattgcggcgacactccccctccccccccttcccacaaattctatggagcgaccgcgggaggaggatcacgtggtgcggtcccgcagctactgtattcgattccacgttttcctccttacg

SEQ ID NO: 10818 - DNA, 734 bp, Homo sapiens
ccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccg

SEQ ID NO: 10819 - DNA, 935 bp, Homo sapiens
gcgtgcgacccgcgcccactgtggtcccgccctactgatgaccgtgaacctgtagggtgttgggccagcccctcaccccaaggctgggcaggcccccggagtccccctcggcccagacagaagctccctcaggagcgggggaggggaagggggcgcgcggtccggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgaggtgagcgggccgggcaggggcggggggctcggctggtctcagccccgggcggggagtagcccctcccccgcggcaactttgggggcgcgcatggggacctcgcggcgccgaccccccggctggggtctggcaggggtgggggacttcatccaggctccagccctgtggggaagggaccaggtgcggacgggtcggcttgggaagcggcggcgctgggaccctctccccctggacaccgccg

SEQ ID NO: 10820 - DNA, 1054 bp, Homo sapiens
gcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacactcccggcttgactgactcagcccgaatatcccccaccccg

SEQ ID NO: 10821 - DNA, 1474 bp, Homo sapiens
ccggacgctgtggcagaggaggcccgcgcgccgcacatctgctgggacccttagctcgcccaggattggtagggagatcctggaagaccagcgcccggaggggtgaggccccgtcttgggggcaaggccgcgaaaccacggcctgcagcttcacgccaggggtacaaagaaaagcgtcgccgggaacccaacacctgcagacgacgcgcagccgcagaggaggcggggcgtccgaggccccgccccgtatgctaatgaagcacacaccacaccgccccgccccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcggtgagcgcggcggcgggagggactcgggggcgggggcgcgcgcgttgctcatgcccgcagctcgccggggtccggtgtgtgacgtcactctgacgtaatcccgagctgtcgggggcgcccgggcctcgtgtgacagcgggcgggggtcggcgccccgagggctgcggggagccgccgggggtccggggcgcagggcgtgcgggcctggccggggtgtgagtctcgggggtccgggccggcggccctgccagccgggtcgtgcggttgcgggggtggggcggcggcgccgctgccatattagccccgggagcggcgagagggaggctggggtgggggcgcgaggggggcggcgcgaggggggccgattctgcgggcaggtgacatcacacctcgaaggccccagtgcgcgggcggcggcgcgggtccggcccaggaacgcccagccggtcgctggagctttccggctggtggggagcccatgtcccccacgggaggtcctcagccctcgcccttatggcggccggccccgagggtcaggtgggtctcacccacaggcaggtacttccggttggagctggttacagttgcccaatacccgtgtcgctgtgtgggctgtttgggaaagctgggctgagggcttggttcggagagcccgcggagacccgggtgggagtgtgtggaagtggagggagcggggagacagcagcatcggcgctggcg

SEQ ID NO: 10822 - DNA, 357 bp, Homo sapiens
ccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccggggatctcggggtctcccg

SEQ ID NO: 10823 - DNA, 814 bp, Homo sapiens
ccgccgggagccccggggctcggcttcagccccgggctgaacaagcagggaggggagaggcacttaggcctcgcctccccgcggccttcctcccctagccggggaggaggagacccaggaagccgcgcccggctccggtgggtggagggcctaggccgcgcctcccagccccgcggccctaggcctcggcccgcccgaggcggagcccgggaggtcggggcggggtcccgggccggtcacccacctgggttgccagtcattccagctccgcgaatagttggtgccgccgctgctcagccgagaccccggggctctgcggctcattaccttccccgacacgacatggccaagcgccgccgcccgaaccggccgccgccgacaccccgctccggcccggggctgaggaggaagccgagaaggaggaggaggaggcggcggcggagggcgggggaagaggacggccgttccgggttccgcctgagcccgcagggcaggacgagggagcggcgcggtgagagaggcggatgaaggcgaggcgacgtctcttccagggccgtgcgcggcccacgacgctggggccccggaggacgaggaggacgaggagcaggcggtggcggcagctcctcacgctcacacggccactgcttccccgcctcccggctccgcccgccgcgccgccgctgtcgtacggcaagctgggagcgagaggcggggtcggccccgccgggcctggggagagaggcgggtcctgtcggcggggcggggccgatagcaggcagccccgccccccacggccccaggctcttggacggcg

SEQ ID NO: 10824 - DNA, 847 bp, Homo sapiens
acgcaaagcgcctttttctccactttcggagatggtacgtgcgcgcttccacgcagtggcggctgctgcggcgagcacgtcccctgcgggacccacgcggggagtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacg

SEQ ID NO: 10825 - DNA, 589 bp, Homo sapiens
acgggggcaggcgtggcgtctctgggactgccggaaaacgacgtgagggaaaaactcagaggctacgaaaaggcgaacagacggagggcctgcctcaggggagctaagcagctcgcctgaagccccccatctggaaatgacgtgtttaactcggcgcccctgcagctccggccgcccttttttgtttaactccgcgcccctccagctccggccgcccttttcgtcgctctcccctcgcggtcgctcacccctgagatccctggttccactgagacgctcagcttcattcggcaactcgcggacaccaagcgccacaaattcaaatacgagatctagagacgctgggtctcaaacgtctcccagagtgaaagacagaggaaccaatcgaggctcggctgacctcagacgtctaaggcgataggcgttgctaagaaaagggggtgggacgatacccagttgccaagacgacggcttccgggtgggcggcttgaggtggcttccggccgccaggcgagactccgcgggaaaactccctgctagagagactaggagatttggggctgcggccgtttcctccggagcacccacg

SEQ ID NO: 10826 - DNA, 848 bp, Homo sapiens
cgcggcgcactcccccccccgcaccacacacacacatacacacgatgacacacattcctgtgttcccctcgatgtaagtggcctcgcctctcgctgggccccaggtgcccctgcaggaaatgcggaggcgcggggagtccagggaacgggcttggggtctcaagttcgtgatccccaccctcaccccgggctccagccctgcggcgccggcccgcagcggactcaccggacgatgccgaacatgacaagcacgttgcccagcagccccacggcgcacacggccgagtagagcgcggtgatggcgattgccagggcgagggacgaggcgctccgcgcgcctggcggccccgacgcattggcgccagcgctggggcaggcgctagggtaggcgtccgaggcgttggcgaagagcgggggctgcagctcggcgccggcggagggggccggttccatggctgccggccggctccgccgcgtccctctccaccgtgcgccctgggcgcggggatccgacgcgaggggagcggcaaggcagaggccgcggccccgacgccgccggctgccgcgccccggccgccccgctgtctctgcgcctcgtccgcctgcctcgccgcccgcaccggcccagcccccggcgtccgcccgctctcctcgcccggagcgctgtgagccaggagcagccgcaggctcctcggacgcgcccgccgcgcgcaccacgtggcccggaggcggccgccagtctgcgcccgcgaccgggggcggacgctgcaccaccggctcggagctgggcaggggaggcctcccgccccctccctagggatgctccgccggctcgagtgcgaccccgt

SEQ ID NO: 10827 - DNA, 1230 bp, Homo sapiens
cgcggcccgcatccttcctgccccgcgggcgccctgcgacccctcccactgcgtccggttccgacagaagtccagggagcagtggccctcgcgccccgtacgtcagacgtggggccaggcggcaggcccccagcccaggaatcggggagtcccctcggaagggtgtgctatccggagtcagcggctccccacgcacttcctcagagtgagaacgcacgcggcgcagccaccggcccgcttctcccaccgggggctctcggaccttcaacttgcctggggctgtctctgtccctcgggcgaggggctcctggggacccaggacacctggccacggggaggcggggcatggggggcagaaagccagatggagcgggtaggagaaggggggtgctgggaggagtcaaggagggagagagggggcgtgcatggggcgcggagttaagagccaccgagcctgggcgcggtgtgcaggcgagggccacggccttcgcagcagcggggaacgcggggagtcgaggcacccagcgggccggggaagaaggtgggggactccgcggacgccgaggagagggcactgcggagtcagcaggccctgtagggagtcggagaggggctgagcagatcctgaaggcgggcgggggacgcacctttcggcggggcagggtgcccccggacacggcgagcgcgcggtacagctcggcagggtgatagtcctccagcgccgcgtacagctcgtccgctgggggcccaggggtggcggctgcggcagggggtcccggggtcgggaccggagcggcgggcgcgacttccgagtcgggagtccgggcggcggggtccggggtggccgccgcctcctccttctgctgcagcttcctgagtcggcggagggtcatggctccggcgccggacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgt

SEQ ID NO: 10828 - DNA, 1094 bp, Homo sapiens
cgcgggagtcccccgagccccattggccttcccttccggccgccgccacgcggggcgccgcgtccccacgggtctagacgtccagccaacttcccggctctgcaaaagcctctgggggtgcgcggggctgggcgggggtgcggcgtggtctcccccagggtgggctccaaagctcccacccccgtccggggcgctgacaccgccgactcgcaagcctatgccgcgctcggagcgccgcggggccagcacgcccgggcgggcggcccggaggaggcggcggcacggctggggcacccccggctccgatccgcgatgaatggggcggcccgggccccgctccccgcagccccgcccggaggtcccgctccccgagcccctcgctccgcggccctcgccagtacgttgcccgggcgcttcccaaactgcccacggagccggaccccgcgctgccaacgctccgctccgggcaaggctgcggcccccgccgggccccggcgctcgctgccccgcacgtccgggcccgggaggaggaggtcgggggagccgggccgggcgccgcgagcgctgggagggtccggccccgccggggagcggcccccgagggcgcaggagcgggagccgggccggagacccccgcgcagcccggtgacacccccgccccgcgttccagcccggggtccccaggcaccgcgcgcgcccaggcggcgcatccgcactcacctccgctccgaggcccgctccgcccgccacgccggccgccgccaacgagctcccggcccgcgccgccccagcgctctgcagcggaggcgccgtcctcatcccgaccgcaggcccgcccgggccgcccgcccgccgggcaccgagccgctctgccgcgcgctgcgcctcggggcggggtgggaggagagggagcagccgccaccctgcccaggtcgccgcgggccagccctgcagccagctccagccctgggccgggtgctgggaaggccggacgccggccggcggccgcggggtctgccccccggaggctggggcggcttaggttacagactccgccgcccccgcaccctccccccagctatttttagcgccgc

SEQ ID NO: 10829 - DNA, 1979 bp, Homo sapiens
cgtctacctttttcgcgtgttggagaactaactagcaaggcagggaatgcggttcgtgggcgcttggcctcctcaagcggctcaggctctcagagcgcgaggcccaggggctctggagccgcggccgcgacgcgcccgagggccgttctcttcgacggcagagcaagagtcaccgcgcgggagccccgagcgaccgccccgctgccccggtaccctcccctcgcagccgcccagagctcttcatgccccgtgacgcccgttagggcagcgcggccggaggccgggccggacgtggcccgagatgtccgggggcaggcagaagaccacgggcacgcgacaggcaaccgccgcctcggctctagaggtggacgttttgtctccctgcgcttcaataccagattttgtttccagacgacatccctgttgcttccggcacttggaaagaccaatcgtcaggcccgagaatgcaagacccaccctcctttgcgacggaggcagccaatccagttgctcgctacttccagtgtcgcatgcgcccttacgcaggaccctgcccaatcgttaccgggacgtcctcctagtcccgcctccggaccgccagagaggctgtcaatcccgcctctctccttcactccattagcgcactaactcacggcgctgtgacgtgcacagcccctgcggccggccggggcgggccaatggcggtggcggatacggcgggccaatgggcgggagcgtctcatgcggccggctcccgccgcagccgccgctgggtcctggagccagaggccgccctgagacggtgcgcgatggaccgagggccccagccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacggtgagaggcgccgctggtctgggggcggtggtcggggcgggcacggggcattcgcgcggccttgcggcctgcaggccttccccggcgacggagctgcgccgcgggcctccgggcgggcctggggggtcggggccgggtgggcgggggtctttgggggcccggggcgatcgtgagggaccaataatgggtcccggagcgggcctacgggtccgggttcggggcagccgggggtctttgggggcccggggtggccgtgaggggcccatagggggctccggggggggcctgggaggtcggcggagcttgggtcggccgtaaggggcggacgggggctccgggcgggcctgggtggccgggggcccgcggcggctctgaggggccgattgggggctccggggcgggcctgggggccgtgggggcccggggcggccgtgagaggcggacagggggctccggggcgggcctcgggggctcggagcggccgtgaggggcggacggggggcttcggggcgggcctgcaggtcttggggacctgaggctgccgggaggggctgccagggggcgctggccgggcgccgggttctgcggagctggggcgccgacctctgacccgcgagaggggcgccttcgccgtgctggtcgtagttgttattctcagcgtccctattattatcgctgttttgaaatgagagcaggcggctctcgggctccgagccggagggggagggcgaactggggacctgggggcgtcggggttgcaggaggcgcgcgtaggccgaggaggggcaggaatgcgggcagccgtgtggggggtgttagggggagggtaggcgggcgggtgtggggggtggctgggaggaaagcggtggcggtggcgg

SEQ ID NO: 10830 - DNA, 1930 bp, Homo sapiens
cgcggggagaccggggcgcgcggcacgcggcgctctcacctgtggatgttcatctcccgtggagggcggtgggccttgtcgtaggagaccttggcgaagacgccggccacgatgacgaaggcgatcaccccgcaggtgatgtagacggtgaagttggtcttgtccttctccgggtcgtacttgttctcgggccccggcgacaccaccttggtgctgggcgtctgtacccacaccgggctctggtagttggtgcactggcgctggtccagcttctcgtggcgcttcttgcagcagaagcggtagtagcaggtaccgcagcagtacaggtagccgctctcgctgttgttacactcgaactccttgtcgtactggccgctcacgtcgtagtagccccagcacgtctcgtaggtgacggccgcgctggccgccgccgccacagccgccgcgggctgcccccgccggcttcccgcctccgggattccgggcgcccgggcggtgccgttcagctcgcggccgccccgtgccagggcgcccccggccctccggcccccgacggcagcgccgcctgcactcagggtccggttggcggcgcggccgcgggctccgtggacgctgggcagcaggtccagggactccagcgagagcagcagcagcagcaggaggcgccgcagcgccatggcggggccgggcgggagggcgcggggaggcttccgcggcaggccgctcccccggcgggccgggctcggaggacccgccgcgcgggccgggctggaggcgctgagcggtcagcggctccggggcgatggcgccatcgaggcgcgggcggcagtggcggcggcggcgcgcggtgcgcacggaccggcccggcgcgggctgctcgggctctcaggctgcgcgccggctccgcgctccccctgcgggctcggcgcgcctcctgggcagccccatcccccgccggcggtgactgcggccccgcgcgcggctcggctcaggcaggacccgaagcgcggctccgggcggcggcggcggcggcggcggcgtggtcccgtccgggcgggtcctgcgggacaagacggggagccggtcacggggtggggcgactggcgctccgggagcaggaggagaaccgcgggcaggcgggcggggagggtgcgcgcagccctcgaggagagagactcggagccgggaggggcgtagagcccgctcccaagacggggtcccgcggccctgcgcgcctggaaccgagagcgcacgggccgcccctccaggcgcagctcggccgcccgggtcccccagccgcccggccccgcagcgcgctcccgccgcaggctggctccctgggacggagccggttgaggctggggtccggcggcgagccgggagagcgcgcggcggctggacctcactcactcaccatgcccggctgcgactgcagaggcggcggcggcggcggcggcggcggcggcggggcgaggcgggaacgcagctgccggagcgagcgagcggagagccgccggctcgccgcctgcactagtgccggaacgtgtgcgagagtgagcgagggagacacacgcactcacacacccgcacacacgggagcgccgcgaggggaggggggacaggggaggggagggcagccgctctccgccacccacgtttgcacgcccgggcgctcagggtgcggggcgggggggactccttttcgcttcttccggatcgcagcagttgaagctccgcgtcacgaaagctccggacagcagttattcgacacggcgaacccggcgggcgaagagggggccgggagcagggcggaacgtccgctctgcagccggcccgcggcagggactgacctcccctgccattgccttctctagccttcgcgaccagtccccaccctaccggagcccggggcagcgcgctgcctgagcgg

SEQ ID NO: 10831 - DNA, 3177 bp, Homo sapiens
cgcaggtggggtaagcccgggttaccgacgagacctgctcgcgtctccgctcccactctggtgccccctcccctccctggcagccccccccccatccgcctaccctccgggctcacttcgactcacctggcggtgggtcttcttcccccccgacccccggcggtgcggcccgtcccccttctgaccccgcgcctggccgtcgtgccccgaaggatatgggttacagaccgtgcggagacaccagctccgcgggcggctgtcctggctcaagtagaagaaaaccaccggggccagcgccgggtacggcagcccctccgcctcggagtccgcgctgcccgggtccttttctgctgaccccggccccggccggcccccggcccccgacaggtcgttgagccgcatgaagctccggggctgtcccgactcctcggcgcccgctccatcctcctcctcgtccatcctctggccagccggggccccgggcgatccggagaggggcaagcggcgcccctcagaggaggtgtcctcacgcaacccgggggccccggcgggggcacatctggtgggctctagggcgcaagctgagcccccgggagggccagttcagcccagctccccctgcccgcaggggcatgctgcccgcggggcgccggggcgcagggaaaccccgcccggcgcgagtcccgcttcccctgcgcccctggggcttcccgggccagccggccggctccccctcactttgttccggcttcttcgcttcgcgcccaggctccggttgccggattcggcgctaccttcggcgaagccgccccgagagggcgaacgaaaaggggggcagcggcggagggcgggggtccggggaggggcgccccctcttcccgcggcgcagctggagccggatctaaggggtcagcatcgtcccggctccgcgccaggcggcgggggaggggaggagggatctctttaggggtgggcttggagggggtgggggcggctccttcccccgccccgccgcgggctcactgtccgggaggggcggggagacagtggggggcagtcccgggcgggagtggaggcggagatgccgccgccgcagccgccgcggtggctgccgctgccgtagctgtcgccggcgccacagcctcctcctccggccgagacgcggagcgagcgagcgaaagcggcggcgaggagccccgcgcacaccacagctggatccctcacttcaacttcaagcctcggccccgcccccagacagccccgcagccaatcgccggacgccgccggccccgagccgcgcgcccattggccgtccgccgtggcagtgcgggcgggagcgcagggagagaaccacagctggaatccgattcccaccccaaaacccaggaccgcccctctcccctccccttgcccctgggtccgctcccgaaggctggagccaatcagactgctgcccagaccgaacccactttcctattggccattggggtctttgggactcccttggagggagcccgaagaatcagagtattcggcgcggggtcctggcgtagggccgcaggccccaggcatcctttgtccacgacccctgatttgggcagcagccggaggacggagctcagctctgggcgggcctggggaagaaaggagacaggcggcacgggggtgagggttgtcaccagggggtcccagagcgaaatcccaggtctccacctggttaatctcccaccctggagttgagcttggctgcgggactgggggagggaaggagcggagctggatgtcctgggggtggggcttcaggctggaggggcccagtcttggagaaacgggcggagctcgagaaaggctagggtaggcatggtctgggcgtggcctccacaaatctcttgggcttattggtcatactcccgagtcaattctgagacttcgaccctgacctcgtaaccctaacccgctggacctgacctcacattgacgctcctgggcttcatccctttgcccctagggaccttttgaagggcgtggactccacgcaggggcttcgtgcttgaacacgtggccccaggcaggtcgcgctggaccgcagagcccggatccccaggaggggctgcggagcagagcgaggacccctaagaaggaacctgtgggggtctcgagtgtgtgggagggggcggaagcacagagctgggctttatcgactcgaccttcaaagtccccaccaccgccaccccccaacttcgtgcctcagtttctcttaagtccctatgtggcttagggaaagagtgtccgcggaactggaacttcgcgggtctgccgccttcactcactcaccttaaccctaccggcagcgggccctcgtgggtttgtgctttccacgcgtgcacacgcacgcgcagaccccggcccttgccccgcctacctccccgagttctggggctcagtcggctctagctctctcctgccgccggcgccactccagaaagctgtgggtacccgggagcggagcgccgcgggtgtgctgggcgccggtggaggggggaacagcgaggattagacgccgggaagcacttccccaacatctgcgagaggtagacacggcggaacctagtgggtcagtcagttccctctccggagattttggggcgcttgcgccactgcggagaggcggcgggatgggtcggatgacctccatcaccacccctcactttgctgaggccatcacccctgggcgttgttcactctcctaaggctgcaccacccacgcagcccccgcgcacctcccgccaccgcagagggttggggtcgtctcagttcccgccccggccgatggggggaggggatgggggaagtggcagagtggctgctgcgccgtcgtctccctggttgccctttcgccgaatccatgcacagagttgtgtaaatgaggccgggcgggctcatttgcatttcatgctaatgagcagatcccctaagtgcctttttttcctggcgggagtctctgctctcattctgagtatgcggcgcctgagtcttgaaccccgtgccgtcttctgggaaaggggggctatttatggttgctccgcgcgtctgacaccttcttccctcccgagaggccgcagtctgccgggtcggcctgcccttcccgccaggatagaggccccggggctggcgcga

SEQ ID NO: 10832 - DNA, 2195 bp, Homo sapiens
cggcagagaggacgccacccacgagagagagtgaccgcggactcccaccgagaggcaggcggtggaggggctcctcttggagaccccgattatggagtggtttcccctccctccagcccgagccgcagcgccgggctcccccacccccccagtccccagccggctcgggtttgaaaactttcagcgaccgagcggagttggcgcggcgtccccagcccgcaggatgtccagtccccccgcctctgccctcgcccactccccgccgtcccgacccgactcttccgggcggcggagcgggaaggcagcagcccttacctgggactcgccgccggccccgctccagcgcagcgtttggggccaactccagccccaggcggggggcgggcgggggtgggagggacgcggcgcggggcgctgggccaggcccggtcctggctgggatggcggggcccgggccgggacgcagggcctgcctctccctgggaccgaggctgagccaggcgcgctgggttgctcgctctcgcgcgggcctgtccccaggcagggctccttgctttcggcgagggtgggctggagcctgcatcaccgttacatcacctccattcagggcgctaatcgggcgcccgccgcgctccaggtacgtgcgctccgtttacacaggaacaaagcctgcccggccctccccgccccgactcacctccaggctgagccgactcgtactttccggctggtgagggagatgggagtttctggccctgccggcgtgtgggttgttgctgttgactgccacgcccccgcatgcgggcgcgcgcacactcacgcgcactcactttctgggctcggccttcgccggggcaattggtgtgagggtgcagccctgcgcaccccccaccgcgtcttccagagagcgcgcctacggacacgcgcggggctaccttggcgcgtctccgtgggggacacctagcctttgtcaccttcgtcctggccctcccgtgagacacacttcaggcacagttcgctgggagcgggccggagcgaggcgcacactcaagacagagtccgtctttgtcacgccttctgcgccccctcccctccccagcttgcacacgtggacacaccgcacaccgaggttcgccttttgcacgcacggtccttctctgggacctccaccagtcaccaagcgtacgtgggatcgtcaccaagcgctcctctcacgcgtgggccgagtccagaccactctggaccgtgggcaaaggtccccctcggcccgactaccccgcgcccgggtttcctgtgaccgttccaggttctgcccaactcggagcgcgctctcccctcccggcgtccccgttccctgctccgacttgtcctaattagccttcacggttttgttccccgaggtacagtgtttagcgcgaccccctgggcctctgcgctccgggacacgttggctctgactccgagtccgtcctttccaggaggtcaggttcccaccagccccaccccccactccctgttccggggtggatctgtgggttgccaccctttcccctccggccccaggaatctgctgaagctggaccgcagaaattgggaagcgaatccaggctggtacttatccagcccgataaacaagagattttccggccgccttcccccggggctgctggcctcgcggggggtggggtgcgcagtcctgggggcccgcagcgaggcctagttagcccgcgccagaggcccgtaggggctgaggcgcacagaggagggagaggttgttgggcctggccagggccctggagacgcggagggagggcagggcgccgagtctcggggtgccggttctcatgacgccgaattgcctgggggatcgccagcggtgcgccggtcggagccagctggtggcggggcgggcggcccggagtgtttgctcaaccctgagcgcccgcgagggggaggggaggcagctggtcacgggctagggggtagcaaggtggaggagcgggggctgggaaaggggagggtatctcccgggctgcttgtttgcgtgcctgccgcggtctacgacaaccgggagtctaaactctatgaatcacccggagttgctggagcgataaacctcaggctggttcctcccctcgcacaccggcttctcggactcctggagggaatgtttgcttagcggccggagctggcgg

SEQ ID NO: 10833 - DNA, 2063 bp, Homo sapiens
cgcttaaagcagaggcggcaaccaggcgctcgggttacgttatctgataacaggacagatgttgtacggctcgttttcctcatacgcattactccgcagtccgcagcaccgttagaaaatccacctgatttcagagccgcagagcgcccaggggtccttctccgcccacccgcagcacgccccgggtttttctcttcccccaaacaacggcaccgggctcctgcaccaaaacacggcgggttcgcgcctgccatcaccagtgcaaaatctgcggggggctgcccggaaaggaccgaatttcaccgctgcatgagttttaaaagggagggggcacatccatcttcagccctccattccactcccgtttgattgtgatgcacaccgggcgtctgcacagccccgtctcacactagcacacacgcgccccggccccggccgcttcccgccgctcccctcaaacccggccggcccggggcctggcgccgcacgcgggtcgctaggggccagcgcccgccccggctcggctcggccgaacaaagggcccgcgaacctcccggcaaagttgcggctgcggcgaggagcgggcggactgccgcgctcacctgggctccgtccccggcggcggcggcggctccgcggggctccggtggcgcgggcctggcggcggcggcggcacgaacaaccgcccgagggcctcgggagtgcgcgggcggcgggggcccgctcagcgccggcgccacggactcaggtcccggcgcgggcggcggcggcggctgcggcggcggcgcgggcgagtgggcggcggcgcgtcccggcaggtccaggtccggccccggcaacgccgcgacgcgtcctcctcctcacgcccggcgggatgcggctccggcggggtccgggtcctaggcggcggcggcggcggcggtggcagctgcggacggctgggcgcggggccgctccgctccctccgcctccggctcgggcgggcccgcggctactgcgacggtgacggcggcgggagcgcggcgggcgctgggactgccctgtcagggggcggcccgggcggcgctcaagactgcgcggcggcggggccggcggcggcggctacggctcccggggccgtcgcgctgaggtgcggagctgccaccgcggccatcttgttgctctaactgacaagaacccccctccccccgcttcagccagacggggcgctcgcgcccccttccccgccccgcgttggcctccaacaggaagtcgtcccggcccctagcacgtgactcccaccgtatctgcataccggagggcgaactggccaatcggcactctgcacctgagctcctcccccgcgcgcccctcccggcccattggctcctcggccaggccacgcctcctcctttccccttaatacccgcccgcgctgtggttccctgcaccgcgcggggagcgcgccggggtgcgagcggtgcgcgctccgagtggccgggacgcgcgccagtcctgggagcttgcactgctcgggggggttacgtggagacttgcgtggtgtcctttaccgccgccgcctgccctccggtccctgggcgctgtggctccgcgttagggtgctggcgggaggggtgccgatccggttctgcgcgtccggtgggttctccgggccagcgccccgcggcgcccgggctttatgctgtaattgcgcccggcggcgcccggcgcccgcaccggcgcgcgtctcgcccgtgccgtgcacacgccctgcaccgccccactttgcacacgcacacgcacacgagtccttggggccctggagcatcgtgctcgcctcgcgcctcccggcccgcccttgcgctcagtcgctccccagggagcgcccagctgcgagcaaaacaagcctcgctgcgaaacagtcccccggggagacagccctttccccggagcacagacaccacaccttcaccgcgcaagccttcggtccgggccgaacccgggcgctccggcgcctacgcaccccacgattcctccccggtgctccgtacgccgccgtgatcctccattccacggctcctcga

SEQ ID NO: 10834 - DNA, 816 bp, Homo sapiens
cgcagcaaagagctccgggcgccctgggggagagcggtcccaagcctcggaaagtgggcagagccccctctcccagggctgagacggcaggcgcggggctcccctcggacccgccccgccaaggggacagtgtaggccgtgccgcgatccagacccgacgcctccgcgggctccgcggcgcccgggctgcctccgccggctgggagcgctcgagtggccctcgggaactcaccgtgaagcaggagggccgggaacaggtatctgagcaggaggcggcgcggccaggacatttccagtcctgctctggggcctcccgcacgccgcgctccgatttggtgcccgggcaactgggcgcgcgctctgccctccgcctccggccgggtgcggccgggccaggccggggcttcaggcggctgccgcgcgccccatgcccggcgggctaggcgcggggctgcggggcgcgcgctctctgggcgccgtcgggcggctgtgggcgccccggcccggtccgcgtcccggcctctctgccgcccgccccgacttctccgcgcccggccccgcgtcccgccccggccgccgcgtgcgccgctctgagctgcagtggccgccaccgccaccgcagctgcagcgtctcttcatatttccagcgcgccgccggccgggcagcctggccgcggcacggaggaggggccctggagggggcggtcgggggaggcgacgccgagccaccgcccccgggcagccgccgccgggggggagcgcggagacttgaaagggcgcgtcgggcaacgcctcccctcctcccactccgggcgc

SEQ ID NO: 10835 - DNA, 368 bp, Homo sapiens
cgtgccgtctgcgtccgtgggctacacacaccccctcttttctcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatgggccacagcgaggtggtgcgggtgatgctgctgcgcggagccgaccgcgacgctgcgcggaacgtgagtgcccgagtcgcgcggccaaagagcgaagcctcccggcgcgcctgtgtggagaaaacgg

SEQ ID NO: 10836 - DNA, 1411 bp, Homo sapiens
cgtcccccgcgctcctcccgcgcgcggcccctggagtccctgaggcgcgcggccagcccagctcgggcccgcagcaccgggagcagcccgccggccaagcgagcgcgggccggggccggggccggggcctgggggcgccgcccccgggagtctttctgcggcccctgaggagcgagggcgacggcgaggctgaccggggccgaaaccatgaaccgaagttttcacaagtctcagaccttgcgattctacgattgcagcgcagtggaagtcaagagcaaggtaagccccccgcccgccccggcggccctgcgcccagtctcctggctaatgaatggggcgccccgcggagggggactggggcggcgtggaggcgacaggcgccggcgacaactttccagttcgggcgccgcgcgccgctccgcgggacgcgcactggggaccccggccgtccttcccgccccccgcgcggacacaaagcccggcagccgcggcgctcagagggccgagggccatcggacagtccgggcagactctggacccgctccgcgggagctgctcttttgttccacgagtgagaggcgatcggggcgcgccacacattggaggggagggcggcctttccggggcgagttgagggccaggggctgctcggattcggggccgtgggggggctctgggggcccgggccgtgggatggccctggccaaggcgccttcaaggctgcaaaggaggcttgttacctgccaggaggagacttgccgccggctccgagcccggcgtcccccacccgctcggtaccaaacatctaggcaccaggcgcgctcccccgcgcagacccagagcacgcacccggctctcccccggcccagacccagaccacgcctccccgggcgcgtccccgggccagacaccccaccccacccccacgggcgcgcccccaccccagactcccccacctccggacgcgcccccgccccagacccagcccactcccccgggcgcgcccccggctcagacccagacccctcccgagcgcgcccccggatcagacccgtacccagaccacccccacgggcgtgcccggcccctcccgctgcctgcgcccgggcggagcgtgcccgaacttgcgggtcgcgatgcgcgtctgggtaattggctggtaggatctggcgcttctgccctttgcgggggtggttccttcgccgcagatgctattgtttgtgagggtctccttggtggaccccgcgggctgaggaggtgctgcagttgttcggggtcctgcgggagggggcccctcgagtctttcgctggctactctctgggagttgagcggccctttcgccctttctttcttcgcaccccggttctcagagttgtgggaaaggctcctaacggcggagtgggagcccgc

SEQ ID NO: 10837 - DNA, 1487 bp, Homo sapiens
cgggccctgcgactcgcggcggaggcgcacagcaggcgctcaaacgatcgtgggttcagggccccgcgccagcgttcccggggccttctggagagaggcagggtcccgccgccccggttcccgcaggaatcagctggagaaaggcgggcggcttggggctgaacttcctccaccccccatcccccccgccgcctggagcagacacgtcgccgccgcgcccctgggaacggtcagggaagcaagcagaagccgggaagccgcgaaagaggcgagaaagtgcgaccccctccccagatccccggtcccccgtcgaaatccctgtcggccggtcaaaccctagacaatggaagctccacgttttcatcctcattctcccccacaagtccggtcgcgggttcccctcggcccgggaccccggcgccagccccggagtcggagcctgcacgatacgccccctcccgccgctccacttctccacccggagatcgctcaccccctccgccccatccccccatttcccgcttggccggccccgcccgacccggaggcggcgccccctcccctgtcccaggcccaggaaggaggacggcggaggaagtagggggtcctggctgcgggcgcagggatgtgggtcggcgatcggcgtccgagggcgtaaaaaggcggcccgaggactgcgcgcgggcgggcagcgcgggaagccgggaagaaaggagggcgcgcgggggaggaggctgcgggtgcggggcccgaggccggggcgctcactttctcgcgccgctcgcgctcgccgtccagctcccgctgcaggccctgcgcgcggtcttccgcctcgtccgcctgctgctgcagggcctggatcttgcgtttcaccgcctccagggagttgaggccggccatggcgcggaggcgcagaggcgcacgggcagcggcggacgctcggctgggctcggctccggcgagagctgcacagccgcgccccggccccccaagcctttgcctgcgcgggggccgcccccgcctctccccgccccccgggccggctgccgtcggggcgatgaggtcacccggccggaccgccgacgtcagcaccgctgggggagggcctgacgtcggcaccgctggccacagctgctggaaagtgccccttttcgggacttatttggagaaagcgctgggaggcgccgccttctcctcctcctcttcctcctccccctgcggctctccccgccttcccggccccggggctccggcctggccccgccgcgggctcccgcatccctgcacacgtacgtcggaggccttcttctccgtgagctccagcttctcctgcgcgtccttcaggtcctcggaatatttatccagctcgtcctctgtcccttttagtttcttctggaggtgcgtcagctcctcctccacctggggacgacagagcgaggaacgggtcagcctggggggggggtcacgtccccgaggtgcaggggcgg

SEQ ID NO: 10838 - DNA, 602 bp, Homo sapiens
cgcgcaccgctgctgtacctcccttaacgtatccgtaacctccctcaacgtatccgtacctccctcaacgtatccatacctccctcaaggtatccgtaccttcctcaagctatccgcaccaccctctcttccatttcatgcgaagattgtagtcccgcagccctgcgaccagcggccggaagcagctaagatgctactgctcccagcatgccccgcgaggcgcgcacagcacaggccctctctcaaggtcaccacctccactcccgttgtatgctgggattgtagtccggccgccctgtgactaacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcgg

SEQ ID NO: 10839 - DNA, 628 bp, Homo sapiens
cgcctcaccgagaacagaaagtgcgctccaggtaccacccggattccgtcaaactacattacccagaaggcagtgctacaagggacggaagccgaccccaagccatagacggaaggcgcagaggggcgttcccgtagcggcgtgggcgggacttccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggtgagtggagggttccgcagcccgcgcgagctcgggtcaccgcccgcatgcacccatccgctgtaatacggcggatgccgg

SEQ ID NO: 10840 - DNA, 215 bp, Homo sapiens
cggctgcgtattgatcgcacctgtcatgtcccatctcccctaatcgaagctgaaggccggctccgatgcctgctatttttcataattccaccgcagccgacagctccacaaacaccaccgctcgctcagcctccgcctccccgggccggctgccacctcgcgccctcggcctggccctggccccgccggctgcactgcacggcccgtccctccgt

SEQ ID NO: 10841 - DNA, 2638 bp, Homo sapiens; identical to SEQ ID NO: 5586

SEQ ID NO: 10842 - DNA, 2172 bp, Homo sapiens
cgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgt

SEQ ID NO: 10843 - DNA, 2548 bp, Homo sapiens
cggagctgcagtagaagcgcttccgacctcgtccaggccctcagcctatcccctcctgaaggtcggcagggggcgtcattaccgttggcttctccgcgcggctccggcctccgcttcgggaaccgagtgcctgcagcccgcgatcctggggaggcacagggttagggtaccgcctcggcggagaaagtggctgtgccgcgcgggtggggccgggccagggctgggctgggctggagggcgcggggtacctgagtgaagccgcagctcccgggcggggtgcagaggagactccctgagcgctggagcggggagagccagggcgggggccaggcgccgcagtcccggacgaggcccgagcagctcctgcgcgttccgcagcaggcccagcagcgtgtgcgccagcgagcgcagctctgcggaccggacaggagtcggagcggcggtcagaggctggccaggccccctcccctctgccccccgtccgggtccgggtgaacagaactgaccgcatcgccgccggcgctgcaggcactgctggtgcgccaggcgcgcacaggcgccctgggaccccgggcacaggcgggcatagaaggcgcagagccgggcggcgtctgcctgcagctcctggggggggtcccaggccagaagctccctgcagctgggctcgcggctggaggaggctgctgcgggcgggacaggggtcagctcaccctctgtttggggccctagccccctcactccttccccggaaggagacaggctttcccgaggcagaagggagctgggaatgggcatgggccgggtggaaacgggcttgtcccacggttgtccgttggggcactggggacggggcattggaaagagggcgctcaccgctcatctgctcctggagccagtccttgaacactgccacgcgggtgtagaccccgggcttccctggctccccgcagccgtccccccaggaggtgactccgaacaggacctctctagggcgggggccaggctcagaacaggtcagggggcctcccgagtcaccctgcggggccaagagagaggacgctgcattcacctgccccctatgacgcctgccttacgcctggcaggtgtgagcttgccacttgtgtccattttagggatgaggacagagaggctcagagaagtcgagtgacagacagacgtggaaggaaaagaggccgtagtggccctgggaaggctcagccggccttttctcatcagactgggttcatacctggcacgagtcaacgccccccgccaggtacccggcgcagagcatggtgctggggcgcagcccgggccccagggctcttcggcaggtgtcggtgctgagcaggggaacacgggcctctctcactgcttcagcctcaggcccgtctgcagggaaggggtggaaggctcaggtttggagggcaagagccccgccttgagggtccccttcccaccaccccccttgattcctccccctttgaaagagcaggcagcatttttccaaggcaacccggcctccctacactctattacctcggacccccagttcttcccaccacgcgccggctcacccacgcccagtaccttcgaagagggcgccccagcccgcgatggcgcaggcggttccggcagggggctcctggggctcctggggcaggcacacggggcgcgccgatccccccgggctcaccggcgtccacagctgcaccagggccaggtcgttgtggaaggtccgcgggtcaaactgaggagggggaggcggcgcagggtcaaggaagcacgggtgggggtgcggtgcccagccttgggggcctggggactgccttctcaccttggggtggggcaggatgcggttcactggcacctcctccgcttgctccccccgggacccctctgccagcgtcacagtccacagaagctcattcggggcgctgcgggtcgagcggcagctgagacgcaggaaggacaggggcacaccccgcaggcccctcggagaccctgcccctccgcccgcatgccgggctttctccacctgggggcacggagggcgggccggggaggggtcccgtcccagagggggcgaactcgcccggccgtgccaccccctccgggctggcatcctggcggggcgggcgcggcgccttgagatggggaagcccggggccggccgccgccagggggcagcagagaccacctttcccgcgcgtcgcccgccggacaacccggcaggtgcggggcccagcgccggggaccccagctgggcaaggcctgggggtcctacttaccctacaaagcagtgcgctgccgtgagcacccaggaggccgctaccaggacgccgccgcacagaggctgcccgccgagctgcagcctcaccagccagggccaggccccgggcggcgccgcgctgccccccacgatgcggccgtgggcccgcgtcacattggcagtgctcggacgcctctcgccgcacggccctagaaaggggcaaggggtgtcacgagggacatgttctggccatcctcgccttcgaggcccacccgg

SEQ ID NO: 10844 - DNA, 919 bp, Homo sapiens
cggtggggtgtgaacgggcggaagccccgtccagtgcctgtttaaccacctccagcttgtggaggccgagcgaatgcgggtgtggggtccgggccggggtacactcacgcgttgcgctggcaccgggactggatgcagatgagcaggcgcaggtggtcccgggggcgcggcggccccctcctcggcggctccccgagcgctgcgggggagggtgggacgtggtcaagcgggcgggcggcggggtgggcgacagagcgggcgatcctcccacgccccgggcctcacccacgtgcagcgtggcggcgagagcgtagaagccagccacgggcgccctgtactggccgctggtcaagttcaggcccgggccgcggcggaaggcaccctcggcgtcgggctgcgaggggcacggatggtcaccccggctcccgcccggccggactcacccgccctcccgcgcgccggcactcaccaggtagtagacgccaagctcgtgcagcgcgcgccgctccaccaacgcgtcccggcgcaggcggcagaggaaagcggcctccacgcgcggcgcccgcggccccggggccaggggcgcggccagcagtgccagcacgtcccccaccacgtcgtcgtcgtcctccccggcggtggccgagaccggggcgaggctcgcagcgaccggcccggcggggccacacgtacagggttcgggctccgcgcgctcccgctgccgcaccgcacctggcacagagcgagcggtggccgcgcgccagggacccctcacccgcccgccgcgtgggtccagccctgaacgacaggtgctagcgagaccaggggcctgccgggcgcaggggtggggcgagggcgacgtcccctcggcctgaagggcctcggagtctttgcgtcctgaccctgcagcggctcccgt

SEQ ID NO: 10845 - DNA, 2488 bp, Homo sapiens
cgggccgagtccgaggttgctcggaggtccagggctcccaccccgcgatgccagtcctgcctcctcctgcgccccgggcaagggtctgtccgcctgggggaccgcatctggaatccgcgtggctcccctccccggcggtgccgtctccacggacagtgcgtgcccgggtctgggctggagcgacgtccccgagattatcctattactttacaactgtggctcgcgcgccgtcaggacccggcccggtgtgggctggcggagcacaatgaccggcggcggggcgggggcgggcacgcgggcggcgggcgctgggggtcgcgtagatgtttgggtcgaacaggtgagcgcctcccggacactcgggtgcccgcggggggcggggaggagggcggagggggtgtaaactaagtggtgggaaagagacaaaggaagagtgaagagcgagacggtgcggatggggaagggggaggggcgcggaggggcagccggtgggcagcgcgccgaggagctcgagcttgaacttgatcaagcactgggggccctgccgtgggggtggggcgggggtacggccgagagccggccacgtgcctggctttcccagcccggggtctcgctccggccgcccgggggagccgaaccccgaggcccggcagccccgccccacaagtacccgcgtccctggggacccgaaagacgcatgggggtcgaaggctgcccgaaggggccccgggcgccgagagttcctgagggtgcctgagtcactttatttgggccaagtctccctctcctggcctgaccgcagacagcccgccgggtgccctctccccccagcccccaccggacccagagaccgcagcctccgggagcgatgggtaggcacagatcccagcgccttctttccgggctcagccccgtgcaaggatcttcctcgaagcgcttcccccttaagagcgcgctccccaccgaagcgcacggcggcgcgtccagcgcgcccttatccccccctacctggcccagctccccctccttcctcctcttctccccccgcgcctctctccctcctttctcctctcccctctccctgggtgcctccttttcctctctccccttccccccgtgcccactcctccctctcacccgcccctccgccacctcctcctgctgctcctcctactccccctgcctgcgccctccctgcgctcccctcccccccgcccccgccccgtgcccggtcccgccccctctcccgcctccccgtgcccggtgccccctcccccttcctccgggccgcggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggtacggagtccggcccggatcccggcgatcgggccgtttccggggcccgggccgccgccccccttctccggctgctgccgccggccgttgagctgcggttaggggggcgaggggctgggggcggttctggggaggggggcgcagggggagcttcctttgccggggctgagggagggggcgcgggggagcggctgcgccctgggccgagtgggctggggcggggggcgggtgagtgtgcccgagagtggagggggggcgatgaaggctgcactgtgggggccgcggggcgcccaagaggtgtgtctggccctgagcgcccagggtcgcggggcgcaccccactcccggggtgcgcgccgcgggtcctggggggcggtgattgtgcgcgcagcgccgcggtattgtgccacggccgctcggtgtgcagcgggctcggcaccgcgtcccggcgagggaggcgttctctggcggcggggcgggggccgggctcgggttgccgcggccgccacgagaagggaagtggactgtgtttggggatgtgaggacgggaagcgttgagtgtcagggaggggttccccggcgcggcgcggggagttgagacgcggtttgcagagttgagcccacttcagcaggcccgggtccctcccgggaggggacggggtgtccctctcaggtgcaccgtctgaccggaagccgcgggcgttggcggcccctggcgaaggggccttccttaatgaggggacacggcggggcgggggcagccggccgcctcgagggcgcgcgcaggggttaagttggatttacacctccgccctctctctcctccctccaccttgtcttcaaggctggacactttggatagggaggaggggggagtgcaatccgcatttttattccagccgctcgggagcagaagtgaccctgctcccacccggagctgcgtttgcccgagtccggccgcccctaccgggctgcgc

SEQ ID NO: 10846 - DNA, 513 bp, Homo sapiens
cggccgggcttgtcacggggctctgtgcagccttttccactctcccggctgccagcgtcccgccccgtcccctcccagcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctatgagaccgcaagccaccctccaagaatgcgcgtgcagtcgttgccgtggcaacgt

SEQ ID NO: 10847 - DNA, 1766 bp, Homo sapiens
cgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggaggtaaaagcgctagcgcgcggagggctcgaggagggcaccgcggctgggccccccgcgccccgggccccagccgtccgcggctcccggcccgacgctccccgccccggagcgcgcccgcctcccctgcgtggaggccggcgggcaggcgagcggggggcggtagcgccgtgccaaggggctggctggggcagcgtggccggccgggctggggcgatttaagagcggtccgggcggggtgcggagccggactttggctggggcggcgcgcggggagggggccgggggcggtggcggcggcgttggggggcggggaggaggcaggaggaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcaggtgggtggctgggggacgcggggctcgggcgggggctcgcggcggccggagccttccccggcgtgagcccggccgcgagcgccgcccaggtgagccggggctggtccggaccgcccggctccagccccagcgctgcttgcggaggtgggtccgggcgggcgggagggaggctccggcgccggccgtccgcagagggatgacctgtttgaccccgctggctggcgggcgggcgaggacttcccgccgcgcccctgacccgcggacacggcacaccgagcacaggcggccccgggtaggggagcgcgcctgggccggccatccgc

SEQ ID NO: 10848 - DNA, 6511 bp, Homo sapiens
cgtagggtgaacaggtccggtcaggagccgcagcgccgctcacctgcacctcgtccatctggtgaggcatgtcgtggagccccaggttctcggccaggcccgcggcatccagggcgtgtgcgtggggcagcagcaggtcggagcggcggtaggcatccctgcgggcgctcaccgcgcccgcctccagcccggagaggtggggcagtaggccggccgggcgcccgtggtgcgagggcagccccgctccctcctggctctggcggccgggccaggcctgctgctggctgcctgtgggcgccggctggtgcagggggttgatggcggcggcgtacgcttcccccagatgcgagtaggggtcggccgactgggagtaggccagctgctggtagggagggggaaagtagggtggcggctgatattcggcgactccagtgtgggagaggggtggcgcggggctgtagaggtgctgcccggcggaggagaggtgggggacccgcggattcccattgctgctcccgtcgtggcgatcctggagggaaaaaaaaaaacaggagaccccgttagtgcgaaaccccgctactgcgaactggccggcatcgccgggctacgcagagggccccgggggaccaaccgcaccccgcccggcggggcttgcccagggtcggaaggtacccgggggcaatgcgccccgaggatttcgttgtaagcaaagagtgcggggagggaggagagtctggtgaaagacctgggggaacgagttctcaaagcccggcggcgaaggtctaggcgctgctcccaagcccgaggcgcttggaggcgccaagtccgaaccctgggtcttgggccagaaaagtccgtggccggagcccggggcgaaggagccagagcccggggcgaaggagccggacgcccggtgcagagctatctcgtggagcccgcccatgacgcagggactgctggaggtggcagcgcggcaggcgcggatagagtgcgcggcgcgggaaatgcgcacctcccccgcccccgggaccctcccttccacgccctcgggacaaagacctccgagcgggcggcgctcggaaagcagggcccgccaccctgcgccgccctgggaagtgaagagggagcgcgcgcacagggcggccctccctgctggccgggcccagccgaggggagtaataagtgggggcgccctgcactgccaagggcagtgttctcgcacgtcggggcgcagagggggcatgaagaaccctggaaattgggcagccttgcccgcgcacgttccctcgcccctgggcggcccgactcagtttctaaaggatgcgtccccatctgcccaggggtctcggggcgccgggaacctggaggaacatggcgctgtcgcctcctggcggaagcgcccgggcctgcgggcaggggcagccctccagggcccggaggcgcagtgaactcccgcgagtccgtagcccgagctccgcgctcccggcgcccctgagctcgcctagcgctgcctgcgtcttcttcctcttcccgctcgccgcctccttcttccctcccactctccgaaactctagctcaacctgtccgacaggctggagcactcgcgagctcttacggccccatctggcctcgggcacccccaccaccactccccagcccccacttcttttgaaagccaaacttcggttgttttcgtgcttccccgaggaggtagcggggcaggtgacaagccggccttggaggagtgtccgccaaggtgtcgctagcaggtagcctcatctgacccctttggacagagacttcgtgcgtaaaagccacgtctgagggttgcagacggggcacttttccgagaaaacgggaagcagggctgtttgccgcttaggaaagcgcccggtaagctgtgtgggtgggatttgccattctctttccaggcctcgttcccgaggggaggctatttaggaaaaggccctatacaggaaaggggccccgcagaaatggactaaggggtgtccggagaagtggatcccgtcccaccgagaggccagggctcctatgccctcgtccccgacctcggtccagtggcccctgcctcccggactgtcctcggcggggcggggctgcaccccggagccccagctcacctcgcagtcctcttcgtacttgacattatcggttattttccacaacatggcgtccggcgtcccccaaaacagtcgccagttaaatccaggatccccccagcccccaagcggtaaatccaaaatcggggtcacggtgaccaggcgtctgccgccgcccccgccgcgcgcgggccttgctgtccgggtcactggacacgcatcggcggctctgcgagcgtagatgctgccgccgcgagtgtcaagaccgctccgcggacggggaaagccgcgcccgaacagtgtgtcctggcgatagccgggggacccgagcgccttaatgagaaggaaattatcataactcctccccgggggccggcgcggaggcccaggcgccgggcggggcggcccccagccagtcccagcctagctccgccccgcacccgggcctggcgcagcgccgagccccacgctgtgagggacgaagcgcggagtcagtgggcggtgcctcgttgacagccgaagacctgcgaggcctgggtcccccgacgcgccttccttctgtcacctccaccgtaaacacacctgagattggcagagctgggggaagggatccaaatactgaaacccacccctctttcgcctaaacggccttcactcgttcctccaaaagacggatgtcacctggagttaagaaactgcgcatttggggagcgactcaacaaccggggtctcctcatctcctaaaaacacatcccatcccacctacaccccactgaggcttaaggtctgagctgggatcatgcagctggagccccagtgcgccagagacgcccagttccctccgtgggcacagcgcggtcccggcccccgggcgggaggagagaggaagggactcctggggagtctgccccaagggccgcagaggcagcagacggtcctacccgcccaggagttgcggacagcggcgtctcgccgctgtcgcccgaagtggcatctcccgcggctggctgaggccagggggaacccgcgcgcactggaccagcccagcggcccggccctgccctgccctgcggaacgccggctctgcagctgcctctggcgggccggtcactcagaagcctctactcgccctgggaaagaagcgccgggcaggaataaaacccgagcgccacgggtaaggtgagggtgaggaggtgcaggaagttgggagagagcctgcagagagctctcgactggagaggtagacacccaggtcccacatgtttagacagaaaacgaaacttccttccacacaaacgctgcttccctctccccttcggtacttgccacccaaacttgaaagcaaagtgcaatactaatttttaaaatttaaactaacgaaattctttggcccagttattatgcagcaattgactttcattgtaaggggaacatcgctaattctcgagggcgtatttgttgggacgccccaactggctccctgggctggatttaaacattctgtggggattagaggacaagactatttctatttgatactgaatacgattttgcaataatcaatgcctatcagtacggtgtccgcacctgcagtagacatgactctcccatccacggaatggcggcatccactgcctcgctgttccttctcgggttcgtttgaactttagcatttatttagacccaggtgggcctaaaagaaaataataataataggcgtcctccaagggaaactttcccccggccttagacagcagccaaatcccaggtgattttccgaccggacgcgggaacaaaatctggaagttgaaaccactgagacttttcggccaagcatatctgcagggctttgcactaaggagaacagtgcataaaaagacacacaggaccctgacacttcggtcccaaaacaggcttctgggggtaaaataagttaccgcagaagcagcgctcctggtattagcggcgggggagggggacacctgccagaagcagaaattagacccaggcccgcaggcactccagagcacaggtccaggaagatgggtcctagactcgccagaggtgcggcgcctctttcgggcgcctgggactccctgacgggtgccgctgggctgtccgacattctgggccttctagccctcggttttattctctgacccggcctgaggtgcagcttgaacaagctgtcttgtctgtgctggcaagtttacctcctgcacgctggggcccggaatgggcaagaaggtgctcatcccccatcccaggccctggctctcctttcccacagcaacactagccaaagctgcccggaggaaccgatatgcctccccgcctgggagcgtctacgcaggaggcgaagggagccgatgggcactgagggctcgcgcagcaccgtgccgtgggcccaaaggacccagaggatccggaaccgcttggcaaaggccattcattcccaaggagcttccctggaccccggcgctgccctctttccaatgggtaagcgttcgaactggagcgcaacctccgcgccctctgtacggaaggcagctagaacaaatcctctgtcttctcggcacgggagacccttccccaatacgcacattctcggcttctgggccggcacccaggcacgcgcgcgcccttgtgaggaagcctcaacccttccttgacttcaacttttctgctcagcagagccgggaaccgaaggctccagcatccaagacagcctccctccaacgtccccgccccttgcccacgtgaagacgcggactgcgtggccgcgctcaagacagccggcaccggcagaaggggacccctctggaaccccggaggcctcgcagccgcctggagaagaggatggaaggttgtcgggggttcccctctaccgccccctagggagcctaaactcacttactccctggaagccctggacccacgcccctatgaaaccgcaaaccaggcctctgcaacagcgggagcgccccaacagcgcgccacttccaaagaggcgcgaggtggtgcctttggaaacagggctcccggccccaggcctgagtcatccgccacccctgcccccaccccagacggaagaaggcggccaggcgggtagagcaagattcgggcagatctgcgactcctcttcccgccccagggaggggactcccgagcagaagatggaggcccccgagcgctttcgcagactccgcgccacgcgccggacgtttgtcccgcctctcgggacaacgtgagcgccggtagggacctcagtaagtggcagacccgccaggatcaagcaaggtggaaaggccggggcctgcggcaaacccaggaggagggggcattcacgcccgccaccctcccttcgcggcactggcacccactggaccgacactggcgtcaaagggcaccctgaagtatctatgtccagtaagggcatgccctggggcaccacagacatcaagtcacagccactccaaaataattacaaaaatgattatcgtaaataacagattgctttaatagggcgcgaagcggccgccgcatacagacgcctctggtctcagtcccaccagattcagttcactgctcgcttctttgcgctccgcgtcaggccgcatgctcttcgtttagaaccttttgagccttaactcttcctctcaaacaactccttttttcaaacaggcaaagtgaggcgaggagctgaggggctcacaggttcccaagcttccgaggagggcccgggtccacgtcagtcccggcccgccaaacgagacttcgtgggcacagtctctaacctgacaaccacctgtcccatttcacagcaggcaaaagtgaatttttagtcgcccaactacctgaaagccacaaaggtgcctagggttgaaggccactttcctagcggttctactagggagcccgttagagacatgcctgactctccccctgccctgccccgggggggacccccgcccgccggaggcctcacacgcttggccgtgggatggtagactcctgtcacctctccactaacatcccggagcccatccgtacgcaccctaaccgctcggagcgcaggcccgaggactaaggcggtagcctcgtgtcccctgaggccttctccgctccgtgttctgggtcgccatacacttcccggctaagcccggcgcctttaactcagaacttggtcgcctccaggcgtggagcaggccactgttgccagacgctgcgcggacccgtcttcctgcgccagtactgggcgacaggcagcccgggcagcacccaggagccaccctgcacggccccaggcgcccgtcccacccagcgccacccctcgcccttcgcagcgagtcctcccgcagcctctcctctctgctagcccccggggtcgc

SEQ ID NO: 10849 - DNA, 6511 bp, Homo sapiens; identical to SEQ ID NO: 10848

SEQ ID NO: 10850 - DNA, 338 bp, Homo sapiens
cggaaacctccaatccgcgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcgcggtgaccccgctgcggaccggctcgcggtgaccccagcgcgaacgagctggctgccggctggggcgagaaaggcctgcggaccggcctgggcgcatgcgcggaaggcgg

SEQ ID NO: 10851 - DNA, 936 bp, Homo sapiens
cgcaggcgcggggtgtcttgagtccctcaatccccagagggaaggagcccaccgtgggggaccggccaaagccccactctttgtccggcccagggcaaatcggcccctcggcagctcagcccgtccagcccctcccgagaggacacaggggacccggagtccgcaggggccagcactaccctccgccccgggtcccgctccctactccccgtcgctccgagacgctccgactctcagtccggaggtgagggtctcccttcatgcacgggcgcctgatgggggtaggggtggggacgcacgagagtcccaggcttcggcccggaccgctcggggttccaacgcccccttcccgggcccaggaacagcgcccccgcaggaagcatctgcctcggagggggccctcgggatgcaccccgccgtgtccgcgtccgatgcccgctcctccagggccccgcgacccctggggatcccccgctccccggcctagggggcacccactccgcacgtggagcccgggcagcgtccccagacgcacccagcgggataccggagaggacgccgacgcagtgcaacgccccggccgaagcgccgaacaacatgcgcgcgtcgcggaggaggtgcggggcgtgctcgctcaggcagcgggtcgccccgacgtggtagaagcccaggaagccgcagcccgcgaaggacaagctccagccgcgctctgcgtcgtacatggcggcggcggcggggcgggggcgcgggttaggatctgggtcgggatcgggaatcggctcgggtcctgatccgcagcagctccgcccggcgcccgcaagcgctctctaccctgcctcagtgtctcggccagggcattcccagcgcgacgtcagccccgcccccctcggaccatgcaaatgagccggcgggaggcccaatgagcgggcaggacgc

SEQ ID NO: 10852 - DNA, 2184 bp, Homo sapiens
cgccacgacggggacctcaccacgttgtccctcatccacgtcacccgcccaacccacgcggagggtcctgagggcttcaccacgcagccctgaaggggcagagctggggtcacacaggtatcggaagcccacgctgtggccccaggagaaggttctggatgtggctcctatgagtgaagggtggactcacagcgctgccggaataaagggaaaccacaggcaggagggaagcgcgtccaggatccgcggccaccggcctctcagactgtcttctggggccaggtcgcgaggagatggaaagcgggggcatcacaggctcgtctgaacccgcgcgttcattcggccacaccgaccccaaacccctgcatgcgggcaggacccctggttctcctgcgcccaccccagccctgctggccgccggggcatttgagggatggttgcggggggtcggagggtggaaggggcgtcgggcagcctcggtggggaggggaagaggcttcccgtgcactatggactcccgcattcgggaagggaggcgctcggggttggggagggaggaaaaggcggctgtgttcggggagggggcagcgagaccccgcccgggctacgggttgcaggatggagcggacgggaggaaggagccctgacgccgcggaccccacgcctgccggccgtcccctccctccctgccttccttccttcctccctctccgcagaggcagcgcggggacccggccggggtggggctagggcggtgcgccccggagcctccaacctggaccccaccccggaggcgccgcgaccgcgctcccgccgcctccaggaaggtgcccggatcgcgccggcgaccggaggactctgcgccccgccgcctcccaccctgtcccgccccgcgcctgtcggcgaccccgcggggccggtccccgtctccacctgcagtccggggcgcggcgcccttgagggaagcggggctctgggatcccccggcctgggcgtgggacaccccacggtccgcacgaaccttggtggcccgggcccctgctcccccagaacagcgcccaggtctcggagaaaccccccgaagccgtgggcccagacgctcccgggggacctcggtgggacgggcagggcgggcgccgcgggcgaggggacgcgcactgtccccgggcgaaccagaaacaccccacaccgggcacctccccaggaatcgcccacccacccccattgttctccaccaggtttcaccttaccaccctccccccaggcatctcccccgttgcatcgcccccacgcgggcatcgctcccacccgggcatctcggctctgtcctgccctggggtggccgcagcccgcggggaggaagcgcggcgaggcgcccacaccgggaaagtgtctccgtgactctgcgaggttacactccgggtgcgtcgctgcgggctcgtgggctcgtgggctgcagccccccgctcctgtcgggtggacgagccccgggcccgcgtggagctgctcggtcaaggccggcccgggaggggcgcggcgcagggcgggcaggggcggggtcctaggtcaacgtccagccccagacccagccccgccgccggatccaccgtgcctctgtttccccattcctgagaaatcggaacgccggcggcacccccttctccgggccggagcctgcgccctccggattgcgcgcctctgtccaggcggcggccgggggtgggagcgcgcagcgggccaacttccctaaagggaactgtcgggagggcgcccagaagggaaagaccaggaagcgctgggtgctgagctggagtctggccccttcctgggggaccggggagggggctgaaggtggggagaagaccgccggggctgctaggggggcactgagggagcgtccagggggagaactctgggtgggcgacgccgcaggggagctgcctggcaggggcgagggcctcggggaagtggagcttctggccgagagctgcatctgtggccggggagggaaagggtcacaagggcagtgcgcgccgggagggaagctcaggccggggggaagggactgcgcggcggggacaggtgcgtcgggtgctggacagtgagcaggagcccgccggtgctcaggtcacgaaggtgctggagccgggggagctggaacgcaagggggttaagggaacgcgc

SEQ ID NO: 10853 - DNA, 413 bp, Homo sapiens
cggcctgacggcggggccgagcaggggaagtggaaggatggagggagaaagggagagagttccagccgccccggctgtggcaggaggagccccaagagcgctccccgagcccgccccgcacctccaggctcagcccggcgcaggctccctctcccgccccctccacccccgccagctgctgaaacccccccaccgtccctccgcgggcaacagtgcccgccaggcgccgccgcgcggtgcctcgccccccacgtcgcccgcccggaaagagcccgcagtggcccggggcgccgcgccctgaccgacgtctctggggtctgggagggcggcgctgagagctgggagaggcgctgagcctcccggtctccacgggacgccgggaaaggagagcgagcgcaactcccacgccccgg

SEQ ID NO: 10854 - DNA, 403 bp, Homo sapiens
cggctcgcgccgccgtgtcctctacccggctacacagcgactccaaaagtttagctttcaccccgcggagatttcgacagctctgggaggctctttttaaaagggaatttggagaaatctgttgctgagcacgattgagtcccactctataaaatacccatcaccccgccgtcattcctcaagtttacgctttcaaatatgcgaaccccaaggtccagcccgggagtaagccaatcccaggacccggtccaccggcgcgtgtcttgaaaagaatgtcggaggtcagattctctcctaccgcttagaggcctcggctcagcgcacacatttggggttcgcagggcttccgcgcgccggaacccgacctgcgctggattttcttccgggcgcaggagctaagcga

SEQ ID NO: 10855 - DNA, 675 bp, Homo sapiens
cgtctcatcgcactccagtggagtgtcgcgaagttgcaactcggccccaaggcggcccgcacttccacccgcacacaaaggcaggtcgcagccccgcacgcggggacagggccagcaaggggcggggaccctcggggccgccgcctccgcagccccgcgtgtgggaccctggggcgggccgccatcttgtggtgcggccgccgcctgccaggagacacctagcaactccgcagcggccatcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccatatgggggtcatggcctggcgtgggggcgtggccgggtggggccgctggatttggtgctggaaagctagggaagtagtcgtgcgtttaagaacgg

SEQ ID NO: 10856 - DNA, 580 bp, Homo sapiens
cgaagagttcggccaacaaagcaaacgtcccgtctccggtctcctcttcctttgtaggggaaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcggtaagcgctgcccgctgcgccctgggcgccccgccgagcagctccgggccgctccctagagccctcccgagacgctgcctgcctgcctccatcccggcgagccgcggtccggtgcccccggacgccagaaagggcgtcctcggccaccgc

SEQ ID NO: 10857 - DNA, 858 bp, Homo sapiens
cgggaacaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggcctccgcagcgccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacaggtgagcaccccgcggtccgccgctgtcccgcgaggctcggccggcgggggggcagttcattcatccaccagcccttccgcggggctggccaggtgagtagtgggggcctgtccctcctctccaggaccgccggggtcttccccagaattgcggtcgggcggcgctggtccctggggaagtgtaggggcacccgccctcgttgactccttggagttctcggtgaactcagcgtgcccga

SEQ ID NO: 10858 - DNA, 5715 bp, Homo sapiens
cgcccgcaccgcgcacacaggtagtggacgcccgcccacctgcccgtctgctgggcgcagggcgctcctggggtggggagggcgctcctgtggggggaaaaggggcgctcctgcctcggagggggaaaggacgcccctgtggaaggaagggggggctcttgaagcggtgtggtgagaggacgcttccgaggaaggaagggggtgctcctgcagcggtggggggagaggacgcccctgcggaaggaaggcggcgctcctgcgggggctggagagacgcccgcgcggtctcccggctcagggaccgctggctcgcgggtccgccctctccccggcgctatggaaaccgcactttctccgcctgccgtccccgatctctttctcctattacctcccaaacgcgatttcaacttcccgacaagctgacaagtgaatggcgcagaggacgccccgtaaagcgcccgcgagcgggtgggacacaggcgccccctccgcgcccctctgtcctccacggaagggcgcgcgccgctctcgatctggagcgcggtgctcgcgaacccgcggccgcgggccctggaacctccccgcgtttcgcggctgcggggggacggagatgcggccgggagacggggacgggaaacgggggacggggatggggcgcgcccaccccgagcgcgggagcggccgccctcgcccaaaatggggaccccgcgccccgagagcacggcccggctcgccgcccatgcttccactgcaaggccgcagcccccgccgccgatcccgatcccccgccccgcccagccgcggccccgcccggcgccccctccccggcggaagctcaagcccaattaattgagtccgaggcgggagggaagggccctgcgcgccgtggcccgccccgcccctcttccgcgccccttttcccgccctgggtggcatctcctccgccggcatccacaacaagccgctgattaatgaggccggggccgccccaccccgcccggccgggccggggccttcgcgggagggggaggggacggcgggaaacgcggcccggggagaaaggggggcggggcgggggcgcgcggcccgcccccgcgagcgccgcgccgattggccgagcgcgccgtccgtcggggggcgcggcgccaatgcgaggcagcggggcggggcggccgcgctgtgtgtgcctgcgtaacgccgagtcacatgttgttttgctcttcttagttcagtcactcggtgcgcgatgtgttactcactgtgcggcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccgg

SEQ ID NO: 10859 - DNA, 858 bp, Homo sapiens; identical to SEQ ID NO: 10857

SEQ ID NO: 10860 - DNA, 247 bp, Homo sapiens
cgggcactgcctgtcgtcagcataacgaagaaacctacacccacgaagacttcagaccccacgtgattacatcactcaaccaccagcgctggcctggaggaacccgctgtcacgtgaccgctcgtgcccaatgaccgaggcccacgctttccagaccgccacagtcgctgtcacagggcctgagtttgggcggcgccccgccccggccgcacggtgcgccggcgttaatcctccccgaaggttccgg

SEQ ID NO: 10861 - DNA, 224 bp, Homo sapiens
cgccgccaagaaggaggaggagcggcaggaggcgctgcgccaggcggaggaggagcgcaaggccaagtacgccaagatggaggcggagcgcgaggccgtgcgccagggcatccgagacaaggtgcgcgccgggccggccccgcctgcgggaaggcggccctgagtccagcggggacccagatcccgcctgggtggaaggggctgcccggaagaggggcgggcgt

SEQ ID NO: 10862 - DNA, 1174 bp, Homo sapiens
cgatgtggcggggcctgggaaatgcgcccgctggagcacaccgcagcctcgcgggctcccgagcggcgcgcgcgggccgaggacctccagggcccctcgcgggtctcccgagcgccgccgcaccgcccctgcccgcgcccgggaccgcctcgtgggcttctttgttagggccgcctgcgccgagaggcagtctaggtcctgccggggacgcacgggccccactcctgacttcctagccggagtcccctgaggacttgtaagcatataggctggagtcgagaggctaaattaggccccaggggactttttcaataaaaccctaaatttcatttaggttgttcgtaggccaagcgattgcaaggactctgagccgaagcagcggtgccgggccgacccgaggctcgctccttatcgccccctccccgggccggctttgtgcagctggggtcctggaacccggtccctcccgggctgtcggccctggggtctggtgtccgccaccctccccccccggaggtcgccactgcccccctaccccactcccagcccttccgtttccctccacgtccccttcccgcgccctcccccacttgaattcttcctcccctccggctggaagaaaagtcggtaatgagaaaccagttcagtgtcagtcggaggaggggggcagataaccccagagatacacggcaatggagagagaactcattttgtgcaaagagggcctcgagtcaccagggaattcctggattgtctcaggctgtcgtgtgtgatgtccatcacgccgtgcgaacaccatctgctcggtattgtgctctcagttgccaggctacctgctgtacgcagtaacacttgactgcctggctccacgttcgcagcgctcgcccagacgcgcggggcgggggccgcggaggggcgggcgggagccctgattaagccatctgcgaggggagggggcgcgggcgcagcggcggccgggcacgaggccgggctgacaccaccatctgctggggcgcgggaagaacggcagctgctctgcgttgccccggcgagggacgcctggaaaaggctgaagccctgggcgtcctcaagcccgttatccacggggtccccgtcaccccagcctgctcgccgccggccgtcttttgtgattccctgctctttggttcgccgc

SEQ ID NO: 10863 - DNA, 8657 bp, Homo sapiens
cgagacgcgccgacctctccgggaagcgcgagcgcgcgcgtgtctgcgtctctgtgcggatctgggcctgccgtgcgcgtgtgtgcaaaggtgaaacggcggcggagtttcaaacatttcatcttcgaaccatctcctgttgaggaactaaggctgccaggtcgttgctgattttgaagagggtctctttcaactgcgatccctttaaggaactcggctctgtccatttccaaggaatgtcccttttcctcactctccagacgctgcaggctccccgcgctgcgctccctcccaggctggagccgcagctggcgggacgcgccgtttccacggtatgccgggtgagagccgcccacgagcggcccagcgtggcggacctcggtcttgagccgcgcggacgcctggccacgaggggctcccgacccgggcggggagaggtgcgacctggggggagggggcggggcgcgtaggaaggaggaggagagagaaaagggcgaagccagcgcgagattaggaaggagaggagggtagagacggagtcggcgagatgctggagaattcaggattgtgggcaccctgagcgggagagaaacttcaggaagcacgtcggaggcggggcatctgtgggaggaaggcaaattttgcagagcgctaaaggatgccgggagggacaagttagccatggggagacctcccagaaatccggagctgaaaacagggcagttaagtaagcaagagctggttagctgaatacgaggtccctagaatgtaaattataaataagaaagaaagaaacgaaagaaaaagaaaagagcgcgcgcagggtcccgggtccaggcgctcagagcagcccgtgcgggggccctcccggcccacagtagccgccgccccgcgtccctgaagtggcgcccgcgtggctactcggggatctcccaggcctcgggggcccatttgaaaacctcgagaggccttgcacatcctgccaggactggagctgcggggacctttcagtcttccacggatgctcctctgcacgtgttttccaggaaaacatttaggcctcggaagcgtctttgagagcctagaaatgccggttgagcgtgaaatccagtccaacctactcacagagtactagacctagaaacgacgtttgaaagagatgtgggttccatgttgacttaaattttgttccatttataacaacgcttttgttttcaaagaaaagaaaaatttcttagccaaacttctcatgtccccggccccctgttcctgcctcgctctctccctcgacaaacgcggggagccctggaacgggagggccggtgaccgcgaatacggtagcgatgtgatttgatgcactgaaactacttacatttccaatgttacttcattaaaggaaacccacataaaagcgtctgtttcatcttaattgccaaaaaagtttgccacacccccgaacggtaactgtttccccgccagacaccgaaagctcataaggaaccacaatgagaaaggatcaggagtcgcttaggttttattgaaatgcctcgatgccgttttttcttcttccccgaattaagccgccgggggaggaggtgggtcgcgcccaccgttgccgggactcgggccggcagacacgggccacagcgccccctcgccgcccgcgcgcacgactcctggcctgcgtcgcctccttccgtccccgcgacacggaggacggcgccgcgcccggcgagcgccccggccttctcagtcggccgcgtccccggggagaccccgagcccgagcctccggggccggctgttcctcgcgctcggcctcgcaggaaatccccgctcgctgaaacttgcgtgtccacgtagactcgttctaaattctttggctgttgcagggacaataaagaaaaatagaaacagtgttaattttttccccacctcctagggcacacctaggaaagggggcagggcccaccaggaacctgaaactgcccccatcgcctgggttattgtgaccaggggtcgcgtttgcaaagcagttactgggttttccctgcgtgcctgctcattccctccctcctgctcggacggcaactgaaaagcctcagaagccaagtgccgggctctccccagcgaccccacaggcctgagcaccccgcctcgcccttgagcaaaacatcccaggccctcctcttcgggagccgcggccttgcagccctcgtggccccgagacggagtctgggctgagcccgccaccctctcaggcagcctcgccgggaccgccgcgccaagactccacgctggcagcatgttttctcatgattgattttttttttttttaagaagaagaccaagccaactttaacttaagaagaaggaatgtgatttttttctttaatatcagagagctttaaagcaaaacgtagtttatatatttcaataacaatgacgagtgttaagtttttaatgtccctgcgtaggcattttaatttgctacagtcactaccaataaaaacggcatgtagtaagagtcgactgtttaatagtgcaaggtagacggtttttattagtaacaggcagcagcggtatggaacatatagatttcagtggaggagtataattgctaaggggaaaatacacacaggacgggaagaggccatcttcaaactcccaacactgagctaaagagggggaagggcaggcggcgtttctggagatgcaccctgggtgaggggaccctccccgccactgcacgtgtctggttatatatttaattgatgtcagaatcgactgtatccagagcagacactccagctccaaactgaggatgtttgtataataactggctgttttctcttctgcccctggcagaggtccggcggggggaggggggtgggtcaagggagggggagggaggatgagccccaaatgctaatgaaaccacagcgggaaccgctctttagaaatggaaatactccaggccagtgctccctggtgataaaaattacacccgatttttttttcatttaaactgatctgatcgtaaaggaaccctaaaggttgccatctgatctgacagtgtttgtgtttgccatccagcgtgtgggcctctcatttacccctcttcttggaggaattccctcccaggaagcgcaaaaatgtcgcagactgtcgacggcttgcccaacccggctgctttctctctctctctgtttttcagctctatagtaattgattaaaaatatctgtcctggactgaattaggatgtcccatgtggagtcgcaacaaggttgaaaccccccgctgggtcgttgcagggggcccagcctgtgggaacggggtgtctgtgggtggagggagaggtggtcgtgggtgtgtgtgcgtgtgcgtgtgttgagatggcctgaagaggatgtgtgcaggatgggggtgtggtttgtaggaagagtggtgggggagcagtgtgggcgaaggggtgggtgggataactggtagggggcgagtggctcggctcgggagctcctggcgggaggggtaacgtgcctggaccgcgcctaccgggagcctgccggctcaggaggagccatcctcaagcacagcactgcagtttgcaactggttcccttgcacctggggaaagacagcctgatgccgtgagtgtttctcttgcgccctggaccagactggcaacccgggctccgctccctccgcgccgctgcagccgcaccacagggaggccgcaacatgccctgcgtcctgagatcactaaggctgctccgcaggctgcagggccagcaggggtgcaggagtcggctgcaggcctgagctgaggcccgccccaggccactgcgctctctcttctccaccgcacccacccgagacggcttccgaggatagaggcacctgctgggtgggtgctcccaataggccagcacagacctgacactcttccatccccctgagcgccccccataggtgacccttcggagtgggcagccagacgccctcttcggccatccccgagtggaaaagggttggagaagcgtgatggggagagggttctaggaagctggggtcctaggaaccctcgccaaccgcctcgcttctgagccccgcaaggcaaccgcccccctactccagccgcgcgtcacctgagctacctgtaatgcccactgcaccggcggcgccaacctgagctcctgcccgttctcgacgtgactgggaggcttcaggtcctgccagaggcggtttgtcaggtaacaatcatccccccagtgttttgacaacacaaatctgaaagaggagtcaacttagaaaaacaaaataaaataaaactctttaggggacggcgtcttcttagctgaagccctggcgtcattcccaacagtggaaagtcgtaacgttcagggccccgggggttgcgctgcggatttgggggcagaaagctcacctcagggccctcctggcaattcgcaaccaaggcgccccggatccaggtccatgctgggcggagtggaccgcgaggggtaggcgaccagacgcgaggccacgcggggagcctcgggccaggaggcagagcaggtccgggaccgtggaagtgagagccgcgcgcactgcccggaggaagacccgagccgcgggcgccaccatcctgacctccccacttccctgcgacttccggattggacacaggggccgggcctcctcggggtgcacagcggggcaggctgtgagtcccctaattggacccggcctggcctgaccgcgggcggcctctgcctagtccgtgagggtggagaagggggtgggggcggggtagtggctggaaggggcgggggccgggcaggggcgaagacggtggccggggacggtgggagccggccggagccgggcaggggacgtggctccgagtggatgggagtgggaggggtgcgcgccggggcacgcagcgcggccgggctgggctgcaggtccgcgagccgcgggctggggccggagctgctagagaggcggctgcgccacaaaagcctgccggtccctcccgccgcccgcctccgtcgcctccgccctcccccgcctccctcccgtctctctgcccctcccccggccgcggcccggaggctgcagcgggcggagcaggggaggggcgggcccccgaatatgcagatgagcgcgtgatggacagctgcgcgttccaatgtccctcggaaactcgagcgctccttcctcaactcctcactcccgactccagactcccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatggtaaccgggcgcgggcgggacgcgggactcctgggcgccgggacccagacggggctcaggcggagcggggctcgggttcggcgggcgggggccgccgggaatgtggcgcggctggcgactcaggagtcgccggctcggttggccgccccgcaggctgagccgggccccgggtggggagggcagcgcggcaggcggggacgtccctgagcccggccgggacccgcgcgccccccgcgcgtcccctcggctcgccggctgattttctctgagagcctgggaagtgcgtctccgccggggccggggtctggcgccgtttgtccctggtttccgcaccgcagcctggggaggcgttcggagcgggctgtgtgctcgcctgcattggcgtggggcgcgagggtccgcgtcactgcggcctctgagccgacggccgggcggttcgcattcactcgcggggctcagggcggtgggggtcaccgagttaggcccaggagccgagcattcagctgcggctccggagtccggcccgaggcgcccaggtttcggccttactctgtccagcggaccatgctttcaaatatcgtgcttgcgggcgcgtgacccgctaagggccgcctgagtcctccgtggcccgagcgcagctcctgctccggcgacctgggggcggctcgcgagtctcgaggttactgagctgggccaggcccgggccgcggcgaagcacgttacgggcgattgaggccattacggggttgtcgcgactgccggccctcggcggaatttctgggcagcgaccgagtcgctggggccttggcgaaggctgcaaatgcctcgaatttaaacgttaaaggatgaattaaaatgctaattacggcgtatttgaagaattcgaaacggtgactggcttctgagttgcaaattggatttgcccagctttagagcagtgaatagtgaattgggggctctggggtgtttttttaaccatataagggaggggaagagggagtagggggaggcagccgcactccaagcatctgcagaaatttagatatcaaagagctacctgtgggcctgtgtgcgcgcacgtgcaagggtttgtgtacattgccacgagcggctccggaacacttaggggaagatgggtcattttaggaaagtgaaatagttcagaaattcgagaataaaactccggtactttttgtgatcaacagctggtcccgaatcacactgcgtttttcctgctcttttgcggcgggaagcgcagccccagagccagactcacggggggaacggtggccgtgggcgggcggaggggtggcatcctctggctggttgcccgcggggtctccgcatactccactcacaggctcttgttggttccagggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaaggtgagcgggcagcggccggcgcaaggtctcggggcgctttcttcccaggcggggcgcagagctaaggcggggaggacgttgcccgccggacaccccaggtccgggccggagccccagccgcaccacattgccctggggtcgccgggatttgagcgagcgattcctcgggcccttcccggggaggtcaggctccgcctgtcacgtggccgggtgggggcgaggtgaggggtcccgtggggagggcccagtgccgcaggacagggggcggagggggctccaggtgcctgcgctgtcccctcgtgccacccaccgtgcccgcgcccccacagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaaggtaggcggcccgcggccggcggcgcccgggaggggagggagagccagccccggggaggcggagcgcccgggagacccgagggagggtccgg

SEQ ID NO: 10864 - DNA, 1059 bp, Homo sapiens
cggaccgtccttctccatcccaccccccgggtctccattgccgcggccctgccccaccactttcagctgaggggtagttcggagctccatggtcccttccctagagcggccgccccctcgggcctccccagagccttcgaagagccgcgtgaggaaacggggacctgcccggggcagcagatctccagcggtgaagacgtagagcaccgggttgacgctagaactgaagaaggccaaggccgtagttcccgctcgcgccgcctggccggctccgcccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccga

SEQ ID NO: 10865 - DNA, 1663 bp, Homo sapiens
cgcaacggggcgggggcagacgtcttcagctttagaactccgtcgggttcatcgctcagtgtggacgatcggcgcccccacgagacccatcgagggcacatagtttccactccagctcgcttcatccgacccagacgatcgccagcgcggccagcggccagcgcacagcgagctgcctgggcaactgtggccggatcctagggagcaagctggcttcgggccctacctagctccacccggctcctaccggccctcccacctaggagctggaggatggtcccggggcgccccagggggactgctggtccccggagtctccagccagacgcgccttgttgtgtgagccgcgtgcgcgcccaatttggaggcagccgcccccgccgctgacaggtgctgcccagagggcgccgggtgcggtccctggcgcagctggacgcgcacgccccggtgcgtgcagcttcccgagctcggtcagagagaagagggagccagggcgcggcctgggggacgccagtggactggagccgcggagcttcgagggaaaaactttgcaggcgccgcggccgggattcggttacggctccagcccaccccagcaggtgcgggaggaagaggcagcgccggagtcccgaggccagagagcctcggcggcggcggccgcttctttcccccgagctggcctgaagtcgctgggcactcccggtttctgctgctgcgcccgccgccgccgccgccgccaccgccagcgccgcggggacccgggaggaggtgcagccgaagagggaggagaagcaggaggaggaggaggaggaggaggggagaggaggagcagggggtggaggatggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccaggtgagtgccggtggcgcggccggagacaaggtgcgcgggaccacgcctccctcttcaggcgttcaccacccggggagcggggggcgggggccgggaggcgg

SEQ ID NO: 10866 - DNA, 2065 bp, Homo sapiens
cggagtaggtcgacgagagatttctgagaaggctggcagaccaccgcggatctttgtctttttacgtggagccatgggcgaggcgctcaagaacttgctgaaggagctcgacttcttcaagcctcgggccaggtcctggagcatgaggtcgtcagccaggacgcccagaaatgcactggtggtggaactgaggatggtggcggccacctgtacggggcgcctggcagcaagactgccacttccaccaccggtcgcatctggctccgtggtgcctcgcaggcctggatcgccaagaaggcggcgcagcgcgtacgaggagccgggccgcaggtactggtaggcgcgacgcccgctgtgatcacgcacgtgcacctgggcacccagacgcaccaccagcagcacggcagcgtcctcgtggccgtgcagtgcagccaggtgcagcggcgtgtagccgccgtgggagcgtgcgttcacgtcgactggtgcgccactgcgccgcgcgacctccaccagctgcagcgccatctcgccgtcgccgctcttggcggcccaatgcagggccgtgaagccagacatgaagtcgcgcttggccgccaagccgcggtcgcgcagcagcagcccgtgcagctggtgggtccagcggcccccggcagtccgcacgagccactcgtgctcggacggctccaggggcaccgcggacggcggcggcgcggcgggcaactcctcggcgtcagggctcagcagacgcgggccggcgcgcgacaggcgcctcaggtgcggggagcggcccgggcccaggccgaggcccagaccggactcttccaccgagagccgcctcagcagcagaggggagctccgcgggctcggctcctccgacagctgccggcgcaggccgggctcctccgcccggaggcggagcgtggcgggggccgggacgcagcgcaccggcagcatacagggcttctgctgcggcggccctttcgctgccccgggcccgggctccgcgtctggcggatcagagcagggcgatgccgcctcagaaggggccctaggcggtggggccgcgtctgcggagggtctctcggtggcctgggctagctcaagggctggaagcggtgggtcggcggaccgctccccgggcggctgagcgggctcggaggccggcccccccggggtgtcctgtggctctgttggcagacccaggtcccctggcggctccactggccgcggcacccggaccaagggcggagctcccggggcagaggcgctccgcggcaagaccgtcgaagtgggtttcgacggctgggccgctgcccccggggggccgaagggtgcgggctcgggctccgggggccggggcttcttcctcagcaccacgaacttgacgccgtcgagctccttcaccaccgccacgttgttgacgaactgcttgaagcggtccctgcgggcggcgcggccccgcgggtcgccggcatcgagcagcggcttgaagcggctcagcagctcggagttgcgcaccttcccgccgtgctcctgcaggaagcccagcaccgccgcctggctcaccccggcagccgcagcggcggcggcggcggccagcgccatggtggggccctgggttcctggctcccggggcgggtgggcgccgcgtcgccgcgggacgcgcgggagcggggttccgggaggcgcggccgcgctcacctggtgccttccccgcggccagccgggcgtgtccccgaagctggacctcggtcgcgccagtgccgctgggccggggcgtctcggggcgaagggcgccgggggccgcggggagcgcccacccccagcgccccgccgggccccggccttcggggtaggtttctgcctttgtattctgtccaatgggcgcctgcttccatcccccgcgccgcgctcgccttacaggtgacagctgcccccgcgatgcagagggaaccggagcagaaattcccgccgccccccgcccgccccagaattaaaggcgcagcgctccagctctggtctcggttgctaggtgggtgtgttccctagggacgccgcggtccgc

SEQ ID NO: 10867 - DNA, 3487 bp, Homo sapiens
cgcgcgcctccagcccgcccctggaggcagtccgcgggaccgcaggctggaggcgcgccggcgtgattccgaccgccggagccgggaggaggagccggaggaggctgcggggggctccggcccaggcgaaggaagggcaagaggctgttcgaccgggggcggcgccgggaggtgggtgggcttaacacccaggtcgggggaggggtttaagagacaccgggaagggcagccgagccccaggggcgggtggggtggtagctgtgtgtagtaggggacagggctgggcctctggaagctagagtgaagccttcctggctgtctcgcaggcaaccccatcctctggcagaacagctgcgaatcgccaagttgacccctctcgtcccttggccgagaggagaggatgtctcaggacccagggatgggcgggaagaaaccatggggagccacaagtctgcacccaggcggggaggaggcgggcgggcgccgctccgcaggcgcaggcgagtgggtgggaagaagggagggagagggaggaaggaggtgaggccgggaagatgccactgccgggggcggggcggggccggggatccggcaaagggactgcagcagcgctaggtgggggcgggggctgcaatgtcactcatttgagagtcaggtgtgtgcgtcccaaacggggtccgccacaagccggcatcttcctggtaccacccatggtgcagggccctaggcagagggctggggactgcggatccgtccctgaagcgggacgcgaaccggcagagttgggagaaggtaaacaagggccacgccccctgccgtcgccccgcgggcgcgcacccgccgctccggccgccgccggtacatttccactctcccagcgcctctccccagctggactaccgcgcggccccggaggtggaggctgcccccgaccccagtcctcacccctggcgccgaggctccgcaccctccacactcacctggaaagggtgtcccccgcccctccaaaaaaactgtctaatttgtgcagagcctccaaccccaggagccgagcatgctgcccccgcgtgcagcgcccgcgtgcaccgggccgggagagggggcgacagggcggaggcggtggcccccggaaggtgtctgggaccggaccggctgcacgtgagcccagcgcgaggtcatgtgcaccggctcagcccggttcggcgcccggacgtgctgcgtatcaacaaaatgaaactcggggagacaggagggcagatagctccaggttctcggagcccccgcccgggccgctcgacctccccaccgtacccatctcccgccgcagcccctacgcccggccggagcccgcggggaagttgcagccctggcgcgcccccgcccgcccgcgccccctcgccggcccgggggcgctttgccgcagtcattaataaagaaggtcgccaagctcacccttccaaaagttgttgttgcatgcgcccctctcagcctccccgcactgtactctttaaaacacgactgaccaacatgcgcaatctctctcccctgtgctgtgcatcccccccctctccgcgctggcttcctagaacaggcagccagcaggagagagagggagcgagcgagcaagagagagcgagggagcgaagagcgctggcagatctgttgcaaaaacgccaaataacgtcgtggagatgcgcagggcccatccgccgggggctggatcttaccttgctccgcggtgcccccctgacgggcgctgccctcggctacgcgccgctgcagggaccggcgcgggaaggatgctcccgaagccgggagctcctggggccggcgcgggagggcggggggcgcgcatccatccggggtcgcggcgagggaggcggccgggcccgcggcgtcccaggccccacgccccccgccggggacggtcggcccgcaggacctaagccggtgccgctaggagtgggcgcaaagtaactccatggacgctactcaccccccccaaaaaatagcctccaactgcgatggccgcggtcggcaccattcaccaaccccctgtgtatgtttctgtttctttttaaaccaagacttccttgtgatctctttagaaaaaaaaaatgtgttggggtgggggtggggtgggggcgggcaggaggagcgagggagggggagtagccacttttttcttattcactcggatctccgctcccgacacccccgtcgccgcccccccaaccccccgcccagttgtttggctccggcggggagtccaggtagcgttgcgggccccgtgggggaagggtgccctccctcgcagccccaccaccacgcctgctggcaccctgggcccggactccccatggactctggggcgcccctagcccgccctgtccccagggccgggcccgagcggcggctgcgcccgtgcaagtcccatcaggtctgctcacacttcacacactcacacacataccccgcccctccactctttcactcacactttctgctcacaccccgccccctacgcgccccagacccgggcggcgccccccgcaaccttaaaaaaaaaaaaaagcgagcttatacttaaaaaaatcttttggcgccatattaatgacgtacttaaaatttgccatttctccctgcgtcaaaaagacgtttctttgcaaataacagcctggaggcgacactcgcggagggaacgaggtttgcactgagcaccccgccccccggggctccagcgctggaagaccctcgccctaggccctgcttctgaatcgctggttttaaaatgcgaatcgaataaattgcgtggcgttttgcagcaccagaagtgagcagaaagtgctggcaggaggggagtggaggggcgaacgcgagtcttggggagggggcgcggccctcctccccgcacccactccaaatggaaaactaacattccgggcgggggaacttgaaattgtaggcgacctcaagaaaagaggggcggtccgtagagagggtccccattgggctcgtcgccccctcccccctcccgggtgcctcctggcgcctagcgctgccccgcatttccggggggtggagaaggcagtgatgagcgggtgggtgggtggttgcacatcctggccccagcaggattttgccccggggcgaccccttcctccttgctcttccttcccattaccccgaaaggttaaaaaccgaggggtaacttccaaaggctggcacatggcgaggaagcggggcgcccctctccccacccttcgcctcctcgcccctcctcctccggctccacttcccgacttgaccttgtggtgcacaaacagtacgctcggatcctcgcagtttctggaagaagagcctgcgctcgccaggcgggcgggctgtcgggctgctagccggcggtggcggggccttgggtctgttcccggagccgcgggccacacccacccaacccgctgcgcccgccgagctcaccttctctcga

SEQ ID NO: 10868 - DNA, 847 bp, Homo sapiens
cggtcgctccagcaaagttcccaacttagtcgacatgacgcgcggcgcagccaatgggaggcggagttggcgtttcttggtcgggggggggccggaggggtgggccccgcgtctccggtgtctgccgtgctcactgaatggagagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgcctgtgagtacccctgccccaccccacgcgggccacccacctgggtcccaccgagggggccccaggcgccagatccgtcctttcccctcgg

SEQ ID NO: 10869 - DNA, 909 bp, Homo sapiens
cgggacgggggcgagaccctgggccctcaggggcactgaggggtcgtccatgccgggggacatggccacttgggggcggccctcgtcaaccgcggagtggggaaaaggggggagggatggaggacgaacgcccggcggtgtctaaaggcacgacgcggagcaggaaccacagccctggtccccagaaagcgcgcgcggcccggggcagaacctgccgaagttccagctcggggcgcaagggatgtgggggtcactggaagacggggcgcgggccgcccgtggggaggagactggacccgaacccggcccaccccacccgagcggcgacgccagcgctgaccccaggcgtgtcccggcccccggcgcggctccggcccaaccgtgcacgcccgcggaaggcctcgcacccgcgtcagaagtggcctgcccggggccaccggcccgcaagtccccggtgttctcgaggtccctgccccgtcccgcgcggctgtagccggcgggaggggctgagaggcgggtcgcgctgggacctaaggcgccgccccctcgccagcctctccctccctccgtcaccgggtggccggagacccgggggcactgctggggtaccccaaagcatagggccagcctgagtgcgcaaggtcctgaaaagacgggggggcggcgacaaggagtagggaggggggctggaggaagacggcaaagtgaccccggaagggtccaggcgccccaagcccatcgaagacgggaggctctcagtggcgcctggggggactgtgggaaaagcagctcaagaaggggaatctggagcgaggtgggggagaggtcggcatggccttctctaggagcgccagcgccagacagagcggtgacaggccgcaccgggagtaccccgtctatactgaacgg

SEQ ID NO: 10870 - DNA, 2150 bp, Homo sapiens
cgtctttcgtggccgggaaggccaggccgagcggggcggtcagccgggccgggaggagggggctctccgggccgcgcggccgcacaaagcggggagatctgctgctgcggcggcatgaggcgcgccccctcccgcgagccagcggagcgcgcgcgcccgcccccgtcccccgccccccgccccagcccccggagcgccattcgcggagcggcttacgctagtcgccgggcgtaccgcgccccagcggccggggaggtgcgctgcccggctcccgtaaagttattgtgaatggggagcgggtgacgtcagcgccgaatgtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgaggtgagtcccgggccccgggccccgggccccgccgctgggcggggtggcggggcaagtttgcggggggagcgggcgcgcggggcgggcggggaggcgtggggaaacggcgcgggaagggagccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggaggaggagcagagagtaataagtcaggcatggggagggcgggctgcaggaggcgcgcgtccgcgcgagccgcagcagctgtcagacccgcggccctgcccccggcccggcgaggcccgggtgtcccggcccccagcctgcgatcccagctccaggccgggcggcctcctccttaaccctcggcgtgcgcatcccgggctgctccgcgaggaccttggccgcggcgcctttgcgctcagctgtcagccgccgccgggtggcccggaccaccgcgaccggcggggaatcaaagcccaagtttagggtcgcaggaagaggcgagctgggggcctcgcggcgcagacctggatcgaatctctcctagcgaaagatcgggttgtcggaaagcgtcccgcgtagctaagacctaagggcgccaggcttctgagagggaaaccttgcacctcctctcccacagatcctccatgaagtcaaggtgcaacacacacacacacacacacacacacacaccctacactccagtctccaagccccagaagcttcacccaggagactggtttatgaaggggacactgccctccccgtccccgcgtcgaggcgctccgtggccccgctgtgcttcgctcacccggcgggtgttcgggagcccggcgccgctggagacggcggcgggcggcgctcacgggctaccctaggtgcccacgaggggagagactggagcgagcatctcggcgacctcggtctggccaagcatttgcaggaactcggaccgtgaggggaagcgtgcagggccgggagtgagtgtgtgaaggggtggcacactcctggcttctggggtcgcgggcgcatggggcatccccagcactctcccgcgcgtaggcgagtttggtaacttgagggaagttccggcgcggccgctgccggggtggtttgtctgtggcccgatgaggcgcgcctcgcagcctgctctcccggtcaccgccgtcgccgtgacctgtggcctccaggaaacgagagggaccggggcgccccacccgcgagacggacccgcagtctcccggcgggcccgcgggcggcgagacgcggcgt

SEQ ID NO: 10871 - DNA, 506 bp, Homo sapiens
cgcctcacgacgtccatgctagggcctcccagaccagcggagaaaccagcagccctggaccgcaagcggcggggtcagggaggcgacaacgggaagcccctgccggaccctggacactcaggacctagtgctgcccgggcgccctcccgcagcagccccagggcgaggaggatggggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggctcctcctgtctcaggaaccgcctgtcccttgccgcgaccggcgagtccttccgggtcttcctgaaacagtttcgtcccgaggctctggatctggaagcccaggggcatcgtccgggagcggggcacccactgtgggtctccgccagccagcactcaggcccggagctcggggacagcgggcgc

SEQ ID NO: 10872 - DNA, 1503 bp, Homo sapiens
cgcgctcctgggtacccagaaataggctttccccgggaatccgcctccgaccgggcgtctctacaacacctgaagcttctcaggacgccctctgagctgggcaaggcgagaggactttctcccagagcccagccccgagcaatgcccgagctcgcgaggtggggctgggggcgacaaggaggcggagcggggacttagccaccggggactcctctccaagtcagttcccaaaccattcggcgtcatgcatccacagcccgcgcgcagcccgtgcgccctggaccctacccaagcactaggctcgaccagggccggtccgaaggtcaccgtctacggccagggcagaggggcggcgggaaaagggcccagtggaccctcggtccaggagggccggtcagctgttgggccgcgggcacccaaagttgcgggggtccgggtctccgaccccacgcccagcggggctctagtacccgagggcgcgcgctgcgactcgcagagcagcgggtgcagcaggctggcggggctgggaccgcgagttttgtttgcaaagttcaggcggggcagacgccagggagggggccgcgtccacgcgggcagccccggcgctgacaggtagcgacgcactccctcgtaatccgtccaccagcagcctaaagtgtgcactgggttcccagtgaaatgcctggccttgaaagtttagccaacatcgggtccagcggagtcaccagggccgccccctgccccgcagaaccaggttctggcctcggccacggtgggggtcccgtatcagcccgacaaccccgaggtcacgcgcccgaaggactctctgggacaagaagtggagtggggcggccaggacgcgggccgtggggatcgcgagggaggagggggcggccgcccggacttaccccgtggggtccccgcgcgcgggcgccccggcgtgtcggatcatgccgccggcagctccgggacggggaacggaggcgctcaggcgccgggccgcgcggaacgcggagtcccgggcgcccgcatgtccctggctctggccctctggaagggccaggccgccgctgccgccgcgctctggggctctcgctcccttctacttcctgtatcggagcgagcggggctttcaggaagaggctggccttggtggtcaagggtttttttgtcaaaagccattcggcagcggctcgcggcccggagccccctggggcacacggaggcccgggcggccgcgcccccggggccgggcctcggggcggggggtgctggggccaaggcgccgcacgggcgcccaacctcggggtgccgcctccacaggctgtggctggggctggggcgcgggaggcccgcggggcttcggagagggaaacttagagaaaagtcttccacttggcttggggccgcaggggaaggaagacgccctccgcctgtgccggcgccgaccgcgggccggcaggtggggaggcccagagctggcggggagttcgtcccactcgg

SEQ ID NO: 10873 - DNA, 907 bp, Homo sapiens
cggcccacgtgcctttcatcctggcccgcagaggcctgagtgctgtttcgggcagctccgggcagggctgggtagggcccagcggaccccacgggccgcccccccccgcctctccccagctatttgtctgtcgtccctcttcgtccctcttctcctgaggtgctgtcccggccctcggggcgggggcagccgcgggcagctcagtccgcagcgcttccagaggtgcccgagtctcctgaacgctccgcaggaaagcagctgtgctgcgtggagccctcccctcgtcccggtccctccgtccgtgttcctgtccctcccgttctgcggcgggaggtggcggtgtgggtctccggggaggcgcggcgggctggggaggtggggaagggtgtgcgcgtgctgggggtgggggggaaagacctgccgccccccccccccgcctccccagcccttggttgctatgcagtttctatggcagcggcatcctcagactcaactttcaccctcgtttagagccaattaaggtaaaatagtgaggggaggagggaagagcgtggccagggaagggaggggggagaggcaggaaattcaattcgaagctgcaagtgcagcgtttactctgccaaagtcgcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccga

SEQ ID NO: 10874 - DNA, 1925 bp, Homo sapiens
cgggttctccgccgctttggggctgagcctggtgtcgctgttcacattgaacaggacgtcctcctccgtgagcggcggaaccgccacccggtaaagcgggtgctcgaacagcctggccaggagggaggcgtctccgccggggccggggggcgactcggaccgacgcgggccggggtctcgcagcagcggccggtgcgcggggtcgtggggtcttagggcgccgggatcccgcccccgcaaggcgcgctcggccggctcggccgcgggcggcagtttctccagcgagtgggacgagaggttggaggaggggtcggagctgaagtcctgcaggatgcggagcgtgtgcttgttgggccagcccgcgtcgccggcggcggaggaggcggccgggggctccccggggcggccccgaacctgggcccagccgggcgcggccacctcggcggcgggctgcgcgcacgaacagccgggctcccccgagggccgcgcgccgcgtcgctccagcctgggcagcaggtccagggcgatgtgcagcgcgcaggccaccaggaacaccatcaggatgagcacgcggaaccggcgcaccagcatcatcttcatggccgcgcgggccggcccgggcctggagcgcgttctgcccgcgcgcccctctagctgcagctgggcacgagcgcggcgccgcctcgcgggtcaaggtccatcggtgccgggcggctaccagctccggggctgtccccgggcccgggccgcgtgcagggcgcccgccgccggagcgctgggtccccgcgccatctcgggcccgtccccgctcggcctctccggagcggccgcgccctcagccggggagcccaggggtcctggtccgcggagccgggcgcgcggggggcggctggggccgcagcagggggaggctcggcgctcgcagccgccggcgcggggctcatcgggcgtgtgggtccatcccggccggggcgcgacgggcctgggcggtggcggcggccgcaggcgtcccgatcctcagcgcgctcctctccaggcgccgggcgggcgggcggggaaggggcggctcctccgggccgggctctgctctcacgccgcgcccgggagaccggggctggggggaaggggggggcgaagggcggaaggggtgggcgcggggagcggccggcggggtcccgggcaggtgcagcggccgccccgagcgcagctcccgcctggccgagcctctcggcgccccgcgtcccgggcgggcagatatcgagcgccgcggagccgccccccgcgtcagcgcccacagattggcggagccgccgccccacgagtcacggctgggcccgggccggctgcgctcccgctctccttcctcctcccctcggccgcgccccgcgacgcctctgagctccgggcccgctaaggagagggctcctcctgcccgcggtttgcagagggaagcggcggagaccgggagggcgcgctcggttctggccaggccagcagctgcggccgagtggggggctccggcctggccgcttcctgggaccccctcccgcccggggccgccgccgccagctgcagcctctcggctcctccccagaggagcgcggggccggggcccaggccaagtccctccccggagccgcggggcgtctgcgccgccggatgagctccccgccgggcggcgaccccgtgccccacgcccgtctcggcaaggaggaggcggaggcggccccgcgagagaggcccaaggagcgactgggcctggacccaggggacgccagggcagcggagctcccggcaccggtcccgtccccccccccccgcccacccgcgggacgcgcccgccttaaccctccaggcgccgggcccgctgggggcgctgagaggggctggtgtgccgggggcgccttcctgcttggggccgacgg

SEQ ID NO: 10875 - DNA, 1287 bp, Homo sapiens
cgcgtggcccgggaggctcccggaggagggaagggcctatctcagcgaggggtataggcggagaaggtgcggggcgaggcggccgcgggtccctggcatccctctccttacgcccaggctaagctggcggtgctgctggtgacgctggtggtggccgcggtctcctacctgcggatggagcagaagctgcggcggggcgtggccccgcgccagccccgcatcccgcggccccagcacaaggtgcgcggtgacggctacttggaggaggacaactcggacgagagcgacgcggagggcgagcatggggacggcgcggaggaggaggcgccgcccccggggcccaggcctggccccgagcccgctggactcggccgccggccctgcccgtacgaacaggcgcaggggggcgacgggccggaggagcagtgaggggccgcctggtccccggactcagcctcgctcctcgccggcctcagtttaccacgtcttaggtcggggggaccccctccgagtctcgcgctgtcttcgaaggcccctgtctcccttcccccacgttggggacgcccctcccagagcccgggtcacctccgggcttccgcagccccctccaaggcggagtggagccttgggaactccccggccaagcacaggggttcgaaaatacagctgataccccgcgggcccttagcacgcgccccagcgccggagcagggtcagggtcttcttgcgacccggccccgctccagatccccccagctctcggccgcggacccgggccgcgtgtgagcgccctttgcacctcctatctccagggtccgccgagagccacgattttttacagaaaatgagcgataaagagattttgtactgtcctgactggagagtcccaggccgcgggggacggagcgcccctgggatgcacgcccggctggcccggcctctgggcgcggtggtgagaggccctgacctagggggaccgcggggtgtggggagtgcggagccccactgggggcggggcgaggtgtccgtaggccccgcccaccagcccctcctccctcctgaggccccgcccccccatgcctgcctgcctttgccagcctcagccaggagaagggagcgggggagcggctggcagagacagaggagggtgtgacggcgttgctggtcccccatgggtccagagggcgagacagactccgaaggcacaccctccaggggcctgtgtaggcatcctcggccctccagcgaccacccccgcgtcggacagggtccacttccgagccacgg

SEQ ID NO: 10876 - DNA, 2906 bp, Homo sapiens; identical to SEQ ID NO: 5674

SEQ ID NO: 10877 - DNA, 2146 bp, Homo sapiens
cgaaagcggccctgagagcgtcctcggggctccttcgaagtgtccaaaccaccagcgtggccagcggccccgactccccaccacgtcctcctccgcgggcccaaagggacctgggccccgcaaacccctgccgagggagacgcccgccgaccccgccggcctacggggcgccctgctcccctcggggcggcttctcaggcaggctgagagcgaacgggatgagcacaccccggacgtccaagggggcgcccagcgcctcgaagccgccgccctggcctgcgtcgccgccggcctcgccttcccgggcaggctggaagcgccaggtgcccgcgcggctcacgcagtagatggcgccgtccagggcggcgcagcggaagggctgcaggcccgtggggccgccggggaggcgcaggggcgcgacgcacgggctccactgcttggccaggcagtggtatcgggacacgctgaccccgctcggccccgccgcctgcgcctcgccgcggctgccgctcagatcgaagcggtagatgaagccgtcgagagccaccatgtcggccgagcgctcgcggctgctgctgcacgggcactcctgccactcgtcgcgccgcgggtcatacttgagcaggcgatagaagagggagcccccggacacgtagatctcgccgtggcaggtggtggcctcatgcgccacggcgaaggcgccccggggcagcggcgccacgggggcccagcggtcggcgcgcgggtcgtagcgctccacgctgagcaggcactcgccgcccacggcgtagaggtgaccgtccagggccagcagccgcagctgcgagcgcgcctggcgcaggggcctcacggcgctccagctgtccgtggccgggttgtagcagaagacctggtcggacgggcgcgcgcggccgtcggggcccgcgggcgccacgccgcccgccacgaagaggtagttgtagaggacgcacaggccgcagccccgcgccggcgcgccctcgggcagccgcgtcagctcgcgccactctccggccgccgcgtggaagcagtagacggccgcgtccccgcgcgcgtccgcgtcccccgaggggctctgaggccggctgcccgcgcgctcccccgccggcccgagcgccgcggccaagaggtgggcgcggccggcgcgcaggcggcggcgcagcagcaggtcccgctctgcgcccgacaggcggccgaacacggcgggctcgcgcagcacctccagatagtggtcgctcatgaagcagtaggcggcgtcgcgcagctcgttcagccgctgccgcttggccgcgctcaggacctcgtagcagttggccaggctcagctgcggccccacggcgtcggtggcgcgctgcgcggcgccgggcagctgcaggcggcgcgcgccggccaccacctcggccacgttgtcgggccgcacgcccgccatgcgcccgctgtaggcgtcggcgaggagcagccgcagcgccgtcaggctcactccctgcacccgcagcacgtcccgcgacgcgcgcgcgcggaagtagtcgctgcgcgccgccagcaccgccttgtgcgcgcgcagccggcgccccgacacctccagcaccaggtccggctccccgtacaccgccccgaaccccgggggtacgggcgcgggctccccgggctcctcgggggacgcggggtcctcaagccaaacgcgcggttcgggggacggcgccgcgggctcttccgggcacgcgcgctcctcaggggacgcgagctcctccggggacgcggcgcccgcgctgccggcctcccactgccgctccaccacccgcgggccaccgctggagggcggggaggtggccgcgccttccgccgctgaggcgagggactgcggcggggactcttccccggagctgaagcacagggacgcgccgagactgcagggtgtctgcgccggggacgcggcgccctcgctctcgctctccccggcagccccgggctcagtccctgggtagaggacgcagggggccaccgcgtgctccatggccgggctgtgctgcgctgcgcccgcgcgcccccggttccgcagcctgcaggtctggccaaggtcgagccttactccggggtttccagcctcacagcttttcctggcacgcga

SEQ ID NO: 10878 - DNA, 865 bp, Homo sapiens
cgggagtcttctcctcccgtgcgccgctgcccgggacgagaaacccgtggggcatccaggactaggacacgaggtctcagcctgggcaggtggacaagctgtggggtcccaccctccgcaggcgatggcttcccaaagtctgtacaaaccggtttcgccgggccggccatgcccgcccctcttctcggcgtgggaagccctttcaaaagtggaggggagcgagtgtcgcgccctgccaaccccgactgcgcctgggccctccccgcgccgggctccggagccgcccctcctgactctgcgaccacggccggggaccctgcgcgcgcccgggaatgcagagtctccagcgccgcgcagggctcgccccgacctcggccggccctgggcaacccgctccgcggccagtccccactccaagatgtggctcggctcccacctccgcgggggggaaatgtcgggcgacccccacactgaccttcctgcgcacccagcgcaaactacgaacccagagttggagctgcccgcagaccccgcgcagccagaccccgcgcctttatcccgccccgccccgccccgcccggcgcaccaatccccggccgaggaggggccgcgtggcgccgcggggggcgggccgcgcacgccccccgcagggaggactcagggacagtcagggccccgggagagtccgcgcgcatcgcccggctccgcggcgccagccatggcgtccgtgcgtggccccgccagggatggggcgacgcggtcagagccgcacgcgaccgaaatccgcactctggagccgcagagcgcgcggtcttgctgtttagcggctccctggcaagtgacgtggggaagaaacgcagggcgc

SEQ ID NO: 10879 - DNA, 865 bp, Homo sapiens; identical to SEQ ID NO: 10878

SEQ ID NO: 10880 - DNA, 1463 bp, Homo sapiens
cgcaatttggggcccgcagacgcgcgtggacacaaaaacacacgctcccgagatccaccctccccgggccacactgtggggctgcgtccggggcacgggccatgcctgaaccttcttccaccgccgcgccccgggcccgcgccccgccggccgcccgcactgggtcccgcgtcgcccccgccaccacaccgagccgcccagtacctcctcctcctgaaggttggcctcgctcggggtgttctccttctcggctttgccgccgttgttcatcttcccggtccttcctcgccgggccgggcagggctggggcgcggggctgggcgagggcgcgctagcccactggagccttccccgggcgccggggctccctcgggcgggcgccgcgggctgtggggctggagctggagccggggcagtggctgtcgggctcgggttgggctggggctcccgcggcgagtctgcgacggcggcggcgggcgactcaggaagtgcaagggagagacggggcagggcgcgggccgggagcggggcaccgagacaatcgggccccgggagggcgacctggagagggagggcgggagccaggggaggaaggaagaaggaaggaaggaaggaagcaaaggatggggcgaggacgcgcgtcccaggagtaagcgcggagagttggggctgggggctgcagccgctggaaggaggggacgggggtgcctagagaggaggaggaggaggaagaggaggaggaggagcggggcggaggagcgcgggccgcggctgggacgctgggacccgagagccgctgagtacgcgctccaggcaggctctgggaagtccgggatggaagcagctccctttctctcgccttcctccctcccctctcccctccctcctctccgcgcctctcctcctccctccgccctccctggacgtgggctgccggctgcagcccggagggacggggcgcgggacggagccccccgcgggaggaggggccggcggccggatggcgcgcgccggggaggggcagcgggccgcgggcggaagcggcgaccccagcccccgactcagcggctggtcggagggcgagggcccgggaggccgagggcagggaggtcgggtcccgccgttcccttggcccccgggggccccggcgtctgcgcgccccgggacttcggggaccctgccccgccggggcctggaccgggacctgggatgtgtgcgacttttagtttgccggcttttaccgagggatttgcacccctggccctaagcccacccttcccgagccagacccggttcttcctctgctgcttgaatgacagcatgagaactcgagggacaccggggacagcccactccgggccggctttttcaggacagggcttcaaacccatctccagcgcgggtcctgcgacgcgcccggagccttccccgcttcgcttcctgagcgtcccgcggccccccga

SEQ ID NO: 10881 - DNA, 1437 bp, Homo sapiens
cggtcccccggagctgaggtctgcgcgactggatttaggggcagaatgagtgcgtcgggaaccccaaaaccctagatcaagatacaaggggagtcgacggcccggaaacctcgctgcgggtgccctaagcgcgaggccgcccgggcagggccgcccagggaccggggcgctgggtgcggggcacggggctccacctcccgcgggctggggcgcgcagcgcgcggcccctttaagaaagttcgccgggcgagttcatcaaagtttaaaaactcgccgtggagaagggcgcgggggaagaggagagagggagagcgctgacccaggcgagagagaggggaaaggcccggccggaggccggcgccccgcggccggggccggggcgagcccacggtgggcggtggggattggctgcgcgttcccccggagaccgcgcggcgggcgggggagggggctggccgggccccagctgaggccggttccggccccgccccccgccgccggcgcccgccccctcccccggcgcccgccccccgccgccgctgccgccgccgccgccgccgcggcgcactcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtgggtctgtggccccgggacttgccgggtgaagcgcacgccaggcgggcgcgggagagggcgagcggggcctgccgcgcctcgcggggccggggtggccatcgctcccggcgccttcccgccgctgccctctcgcccgggtaggagcggcccgtgtccgcgggcgggagcgtgcggcctggactgccccgccggacaggcattgtctccccgccctctcgggctcgaggcgggccgcgcgcgccggccgccgtccgggcgtcccgcggtgggcgagatgcgccgcgtccgttccatgcctgccgcccgcgcgccccttgctccccaccccgtagccgctcgccgccctcctccgaggcgcacctcctgcgtggccaggaccccgcctcggcggcacggagcggagcgggattagcacggcccgagggcggcaccctcactccactgccttttccgccctgaccccctccccgtgaccttggaggcctgggccggccggctcctcggttcctgcga

SEQ ID NO: 10882 - DNA, 717 bp, Homo sapiens
cgaggagaaaggccgccaaacggagcgagagctcccatttccacccaccccagtgctatggtggcacatgccgaccaccacctgcgaggcctcttcgcagacttgctccctcggcttcgcagcgcggacgacccgcagcgtctcacggctatggccttcttcacaggggtgagcctgcttcccggatgggtggtgaagggtgaccctggacttgatccctgaatcgcagcggcctgcacggggaccgcgggcgtgctgaccccatgtgcctcgcctagctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgtgagagaaggggaggggtggagaggggcttggcccggtcgcggcgaggtctgcaagaggctgaccccgagtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacgtgagcaaacgccccgcctccgggtcccgcccctgccgc

SEQ ID NO: 10883 - DNA, 1713 bp, Homo sapiens
cggtagcgaattaagctgcgcaggcgccttgcttccccctccatcaacatgttcgattggcctacgattgattacatcattggtccgcgcaaccctagcaggcttctgggcctgtagctgagccgaagctcttccttttgcgtagcggggcggggcacgatggtggcggggggggaggggggaattgttctactacgcatgcgcaccggggatggcgacagggcctctttctttgcttctctccacagctcttcccagccggggggctgagtgccctcccccttctctccctgcccctcccctttctcccccctcaccgcccagcggggcttctaactgacagttgtcgccgggccccgtccgtgcaccgcctccttctgcccgtgtcccccgcaggtagaggggggcgggagggggtgtgagggagaggaggagccggagccgccgctgcggccccctccggggaggggagaggagaacccccttcctcctcgccccctcccagccccccgctggcccgggagggggtggggcgccgaggccgcggcgacccggcagggcctggccggtgaagagcaggcgggcggggtgcggaggggtgaggccggcgagggccgtgcgcgcgccgccgccgggggggaggggagaggagggcacctaggctctcctcttctctcccccctcctcgcgcgccatgtaaccccgccccgccggcggtgagctcaagacccccgcgcgcaccgagccgagccggcggctgaggagagccaggcccgatgtggcgggggctacgcgccgcggccgagccgtgaggaagcggctcgcgctcacgcgtcccccagcacctcgagcggctgttccacaccgcccagcctaggcctgccggggcatgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggtaagcgagcccggtccccggtgggactgacagactgacacaaacacacactcacacgtgcccgaggatgggctgggccaggggcctgggggcggcgctgataggtgctgagtcggtgctggagaagcccgggaggaggagcggcgctgggcggggaccggaggggtgtggtgggtgtgggccgaacccggcttgcgcgtagactgagaaggaaacccgagtctgcagcgc

SEQ ID NO: 10884 - DNA, 699 bp, Homo sapiens
cgcgcgaaccgctttaccctggatccctggaatcgtgcctaggcacccgggcggcggggtccgcccaggccgcgtcaggcagctctgggccggtgggtgccgggtctcccctcctcccgccccatctggcgcgcccgcagcgccgccgccgccgccgcttctctccccagcgggcgctcggagcatcccgcgccgcgttctccccgccccggcccccgcccgccggagcggggcccacgccgctggcagccatcaagtggctcgttaaggaaatgcaggtgagtgcgtgaggccgagcggcagctgctggagacgtggggtgtgtgcctgtgagtgcgagcgagacgaggagggagcgccagcgagcgagcgagcgagtgcgggagcggccgcctcggctccccgcccagccgcgcccgcagccggcggccggagcgcgtgggggcagcgcctcgccccgacagagcctcgcctcctccttgccgtctcggctgcttctccgaggagccgggagccgctcatcggcctccccaaccctgcgctcccctcccagcccgagtcctcccgctgctctttctcctcctcctcccgagcctcctcccctccggcgcggcgccgccagccagcctcggcggggagagtgcaggtactttgccttcagaataattagcaggacccaagccggctttccgagcgcgc

SEQ ID NO: 10885 - DNA, 1191 bp, Homo sapiens
cggagcgggcgaggacggctagttcctgcagtgcccaggcctgcacggaagcgccctggcacaactcagctgaggatacacgctttttcccgcgcagccggagggctgaacagcaaagcactccccgggggaactgtgtgtcagcgcagcctggagagagcaggcccagggggcagctccaccacaggagacaggacacgcctcagtctgggcaaattcccggcctcctttggctctaagccagcagccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacaggaacccgactccggcctccgctcccgggactcggagccctctgggccctggctgtagccgaggccgcagccggtgagaggcggagcctcgagcgggcccctcctcctccgttcccagctacccccgacctcgcgcacgccctggcccgctccctgcccgcggataccttggactacggtgccttcccgcccccaccagtggacacttccgggtggcgcttggccatccgcttggtggaggtcga

SEQ ID NO: 10886 - DNA, 536 bp, Homo sapiens
cggacgggatgtaaagtttgggtgagacggtcaccggacgtccactggaagggtgcggggacctctacgccgacaccccgcctccccgcctcagtccgcgcactcaccgcgcacgcagagcagtgacatggccgaggatcgggcaagcctctgccgcgccccagccgcgccggaccgctccctctttcctctcagcaggtgccgcgactgctctcgttaccggccccacgggtctggcagctcctcatggtcccggtcgcaggtagcgtcccgccgctgcctcggacccgccccaaatctcaccgtctgagcgaactccgggtagcggtgagtaccggccggcaggctggggactgggcgcggcacagcgacgccatcgctgggaggtaggagctgccgggactccctcccgtcattccacccgggatccgcgcgagcgcctgggcggagccaacccgtggtgccccgccccccagccaattaactcacgcccagtccaccgaccccgcccccccccgcgagcacgtaggaggcgg

SEQ ID NO: 10887 - DNA, 728 bp, Homo sapiens
cggccaacacggccaggcctcccgggcgccccaaggcctcgtcaactctggcaaaggcggtgctgaggtgaaccacgtggatctgaaaaggacacgagggtaggagagggccacgtctctggccccgctccgccccgctcctttgccccttctcggccagctccgcgctcacctcggcagggaaacggtggccttccacagtgtgctccgagcccggacgacctgcagccccccagtgcagatgcagctgcagagcccggtactcccgcccgggacccagagccatctctagcccaggaggcagggtcagttgcactgcgtagggagaggcaagtgagccggccccgcccggtagggccagcccaacccccgggcaggcactgccgcgacggttcccttccctgcgccccgccccatccccaagtctcggcggggagaccccctcaccactgtggccattgttgcgcaggcgcagttctgggagcggcgggagctggaagcccaggagttccagggggcgcagggccgggcagaaggcggcgagctgggggcggatatccaccggggactggaagcggcccgcgcaggctggggacacccggggccagggcgggtcgcctggggtgggagagtatagtgaggaagtctgacgcctaggtcaggaacttagggaacccgggtagaaaaggtgagggggtgggacggtgggcggcgggtgggacgcccgg

SEQ ID NO: 10888 - DNA, 1431 bp, Homo sapiens
cgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcaggtgcgtgcggcctcggggtttggggacgccgcagcccggctcggggagggggcgctaggccgggagccgcagcgcgggagggacgagcccgggccggcggggggaggggagcgggaagcgtctttgttgttggcgaccgggatcccttctcggcacaggggaaaggcggggaagccactcctcatcgggtctgtgtttttgagaggattctctgatggttgcgtgaaggggagcggtaggacagtccctgcggtccgtggagcggccggagtcagggggtgggggagggaggaccgaccga

SEQ ID NO: 10889 - DNA, 588 bp, Homo sapiens
cgacctactttgcgagctcgggtgggagtcccaggcctgtaggggccgcgtggcgccaccttccgatcgcgatctccaatggcgagtccgtgcggcccccagtgcgccgctccctcctgcgggccggtggggtctgcgagaatccggggctgggggcgggtctggtagtggcgggcggggacctcgggtcgggaccgagaagcgcctccgaacggcagttatactggggctgctcagtggcctgagctcctccctgccccctccccacattcctttgttctggcgcggggggtcctcgcggcgccgaggccccgctgcgccgcccacccggagggaggagggtctctgggaggcgccgcgtgggggcgcggcccgtggagcccgggcgctagggaccggccggggccggcgtacgggtgcgctctgggttcgcccgggccgcgggagccagggagccagggagccagggaccccggctcccgcacggggcagacaggggcagcgcgggcgacccggagcgcctgcgtctccgcggccctccttccaacagggcaaatccaggggcctgactccgcgcctgttctgcgg

SEQ ID NO: 10890 - DNA, 1203 bp, Homo sapiens
cgcttctctgaagtccgcctcccagcggcctggagcccggggcgtggtcggctcgaatctgctccccaggcccagaacggagcccgcagcccgtaacccgctgtggccgcagcgggtcgcgcccttcgtccccgcctcaggagcggccgaggatctgcccagctgcgggcgccaagccctggccgcactcctttccccggcggagggagccggctggcgctgcggccttcaaggcgcgcggacgtcgcggagggcagccagtcgcgcgggagcgggtagcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccaggtgagcgccggccggggcgaggccgggccccgggcggcaggcacggggctaggtggttctgaaacttggcgcagccgcgagccgagacccccgactcggctagccgcccgggtatgctattgtgcgcgcagcccgtctcgccgtttgttttggtcctgtgagggttgttgtgaggcccaagcctctggcagcgctccgcctaccgaccggctgctgctgatcctcctgtgtgcccggggcccaccccgcggtccgcccgcaggagcgtttgcacccaggttaccctggacccaaaatagacggtactgcaccgtgcagactcgagggttgggcgt

SEQ ID NO: 10891 - DNA, 5370 bp, Homo sapiens; identical to SEQ ID NO: 5724

SEQ ID NO: 10892 - DNA, 1691 bp, Homo sapiens
cgagaataaacgtcagtccctacctttgtggaacgtccaacgcagctggctgggggaacacgaggccttgcagggagcgagccccggccccggtctgacggaacacaggcgacgcacgtgaagtccaggccctatcccagcgcaggcgggcctccagcgacccacagttgtcacatatccggccagcgccgactcccgaaggcgcactccccatactccactccgagcaccggtcccatcgttagggaaggtccccctggatagcaaggccggggcccaggatctgcgagacccaccccacccgccccgtcagagcccaggagcagcaacaggtctgcgctctccccgggcggcgctctgcagaccctcgacgggccaagggtgcccccagcccagccgtgcgctcaggccggggagatgggcggaggactggggctcccgacttccttgacagtttctgcgcgtcagaaactgagcagacacggggcccgcgccacctcgcccgccgcttgccccactccgcgaggctgcgcttccacccgggtccgggagggccggcccgcgtcccgggtatgaatggggctcttctccccaacagcggggaaatcccgccaccgccctccaccccggtccccggagcccgcggtggcgcaggtttgcccagcaagcccctgaatcggcagacaaaggggcaccggaggaaaagccgagcgcttccctaaacttaccggccacttccccctccccaaaacaaaggagccccccgccgacctccgtctctccccgcaaggcgcgccggcacttcggggagcggccacctcggggtattgttcaggctcctgggagcgcgccgcaccccagtccgagcgccgcggggacagttggcgacctgcacctacaggagttccaggggcgggtggagcgttcgggcgccccgagccgccggccggaccctggagggtcagcgcgggacccgcctccccgcagaagtttgcggaccccgcgcccggcccgccgagccctgcgcactcacctcgtcgcgagcagcgcaacttgtggcggcgccgcgcgcccggccgcgctccgaacctccctccagccggcagcctccgagtcccggccgtgcggcggccgaagagggcccggcgccccggagcagccgcgcgccgcccccgggccgcccccgccccgccgccgccgagtcccggagagagcgcgggcgctggaaagtttcggtggcgaatggcggcctgagggcgctgcggcggcggcggggcgggggcgctggcggctcctcgctcccaagcgcggagtgggggcgctgaggcgggcgcggcggcggcggcggcggcagcgggagagggcgggacagcgggagggactggcacggacagtgacctccacggggagctgccgcgagcgcgcggaccccagccaggaggaccgccaggggtccgcccccgccgccggcccctccctcacggccgtgggaggggacccggcgtaccacccggccccgcccctgcgccccgggggagccgcgtcccgaaccagcccctcccctacgagggtagggactccggccctgcccctcccccgcggctcctagtggggacccgcgtcccaacccagcccctgtcccacggtcgggggaccagcgtccctaccaagcccgccccgctcccccacgc

SEQ ID NO: 10893 - DNA, 1223 bp, Homo sapiens
cggaatgccacctgccccgactgccctcgggtggctacaggcgcgggggaaggcgcagggccaggggcgctgagggtgaaacggtcccggcgtccgggcggcggcggtggccgcctgcggcagctcagctgaaacgcagcggaaactgcagccagtcacggggctgcgggaggcaaggcaggaaggtggcgctgccgccgagcgcctggagcccgagcgctcatcatggcggcaagggcaatggccgccacggggagcgagcacgcccctccgcgcgcacacgccgccgcgccgggcctccggggcccgtcaccggcgccgctgccgccgccgcccgctctcccaccccccctcacgggctgtagcggaattttctctccagacaccgcctccaagatggcggctccccctcccggcaaccccctctatcgtcccctgcagcaggcgccgagccgccgccatcttgtcccccgtccctccccccccctcaccgatatttacatagcgaaaatcggcccggccggcctgcggccttcacctcacgcctgcagccttcgcctcctcgccaggcctcaccccggcgcggtgccccaggtcggccgcggagccgacccggggcccctcgaccgcctccggcacaaccgggcgaccctcccccaacccccgcccgcttacggagcgcgcctccgccgccgctcggggcagccgggctcctccccgggcctaactgcggcctcctcggggcctgctcggcgccgcgcgccacgccgcccggcctagcgcgggagggcgccttgcgggccgccgaccaggccgagaccaggccgctgtgcgcgcactaggccccgcggccgcggcggcacccgggactcaccggacggacgtgcgggcggccggcgacggtggcgggtgctgcaggccggcctttctctggagcactgggccgggctccggctggtggggcgggcggagggagggaggaggggccgagctcggagctgacaaaaagcggcccagctccccggcacgggcccgccgtcagcacgtcacgtcaccgcccgggagagagacccaggaaaatgcggaagggtagacaggccccctcctccgcccggtgggtcctcctggcaccccgtgtcggcgccgctcccgccccgcgaccggggagcccagtggcctcgctgcggcggggtctccggcggccggagtctccgtgacagcgc

SEQ ID NO: 10894 - DNA, 1103 bp, Homo sapiens
cgaggcacgcaccaggggggacctcgcactcgcagtccctcgtcccgcaccccgcagcccgggacggcccctggcccccggcctcagcgaggccgccgaagccgcagtacccagccctggaaggccaggcagccgggaccgcagggaccagccccgagcggcggcggcggcggggcagaagggcagccgctcccccgggacccaggacgccggcgggcgggaggcacacacgcgcgcacaagcggaaagaaagcgggcttactgcgtggggatgctcgcccgcgcagctgtctcggcggcggcggccgctgcctgcaccgaggccgaggcgcggcggtggcggcggcggctgcggactgagccccctccgccgggcggtggatgtagggcgcgggaggggcgcgaggggaggggtgcgcgcctgggaggcggggagggaaagaggggaggaagcaggagcgcgggggcgggcgcggctagccaggggcggggcggggcgcgcgcggggccgggctctgcccactgcacggaggctgtgtgcggggcgcgcgcgcgggagacggccggacgggcgtggggagaggggcggcttgccacgcaccccgcgcgcccacgtgcccccgccactggagagggccgggcacgcggagagggtggctgcggggacgcggtggcaggctctttcccgaggaccggctcggatccgaagaccgggaggagggcgggccgggggcgcctcgggccccctccctcgcgcagcggtccttagaggcctgcgggagtcacgaatcactgcaggcggctggggctggggaggtgggagcaacaaagacagccaagtgagggtggcgtctcgcctcaccggggtcctcgctaacctgcgcactccctgaaaagcggccccgcttcggggcccacgccgtttcggcctccgacttcggaacccggtggcttgcagcggcgccgaaaggcccaccgacgacccctccccttagtagcaagccggagggagctaaataagccccatccataatcccagtgccaccatccagagcgttttaacgtcactcagaaagcaccgatggcaaagcggcgcgtggcgt

SEQ ID NO: 10895 - DNA, 616 bp, Homo sapiens
cgcatccaatggcgactcgacagccctacctggcaccggtgcccggctcgtggggcgggtggagggtcgggcagtcgcagggcgcgggctccctcgggtggacggcgcccggccgggccgggccgggccggggaggcaggcgcggggcgcggggcgcggtgcacagcggggagcgcgcagggaggcgaggaggcgcggactgggctccgcccgcaggagaacaaacaggttttctccggccgcccggagcctcgcccctcgcccctcccctcggccggccccttcctctgcccctcctggggtaggtagaggcgcctggcacattccgcacattctcccgccagcgtcctccgcccgcccgccccttctcggccccgccccgcggggctgctggagaaatcaagtctggggctccccttgtcgagcacggggcgagctccagaaggctctgccgtgatggaaaacttccaggcaaattcctccgggcccgtggcccccaggccgggaagcctccgccacgtgaagggcccccgctcctagttgcgcgatctggccccggcacagggccaacgacttccacagatgctgtcgggttaattcagtcgagaactaccgt

SEQ ID NO: 10896 - DNA, 206 bp, Homo sapiens
cgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgc

SEQ ID NO: 10897 - DNA, 1141 bp, Homo sapiens
cgtactaactggcgtgtgcaggcgctgctgcttcgcgctgcgcacggagaagcgccccgaatccaccgcacgatgcggagccaggggcagcgagtgagcggcggcctccagccctcccctgccttctccttgccccttttgggaatggcagggggtttcctatgacaaatgcccgcaaacaggacagggttcggacgaccccagagccggcgccttctccctacactctcagccctagggccggacccgcccccgcggctgccatcgcccctgcctcgggcgccccgcggggaccaccccgccaggtgagcgcctccaggagcctctctgaaactcacctgcgtgaagtacaagttcatcagcgtgagggtgaaaaactgcaggcacacagggaagcagtagagcagccagaagacgaaggggctgagcgaattggccgccacgaagtctttgaagtagaaggagaagaggacggtccgcagggaggcccagaagaggcagagaaagaggaagacgctctggtagctgagccgcttgtggcggtaacgcagcaccagccagagctgcacgtagatgaacacgaagagcagcgcgtagaacacggtgtagacgacggtgaggccaagcttcacgtaggggggcacggccggggtcagcgtgggcggcagcgagtcgttgcgggctgggtcccacggcggggtctccatcgggccgggggcgctgccgcgcggccggggacgctcgggcctcatcggggctcacggccgccgccgcccccgcgggggtctccgcgcatcgcgctcagcctgcagccccgagactggaggaaagaaaacaagccgcacttcctcccccggcaccacatgattcactgggacggcctttgtctgcgattggcagcgccgcgcccgccgcccccgcgcgccgaccggccccgcgcgcccccgccccggcccgcgcgcccccgccccggcccgcgcgccccggcccgccctcccccgggcaccgcgcgccttcgccccgcgaaccccggcccgccctatcctcgccaccgcgcgctcccgcagtgcgcgcccccagagccgcacgcctcctcccggccccctccccatccccggggccgcgcgctcccagactgcgg

SEQ ID NO: 10898 - DNA, 1819 bp, Homo sapiens
cgcggacgcaggacgcagagccccagcaccggcagtcaagaggacgcaggaaagcgcacgcactcacaggctcagagacgcggacgccagacccaggcttggacagagcagccccgcaagtcccaacacactttgtaaaccccgaagacaggagagagccaaaatactctccctgcccgcacgcaggccccttctgtcccccacggcccgattctgggaggcggatgaggatatccccaggcctggatgggggccatgggacatcccactctagaccctgccacgacctgggctgtgtccgttcggtgctcccggcccacgggctgcacaacttggcggccccgaaactggcgtgggggaggggagggctgtccacccgagcaggacgcggctgtccactcagtcggaggtgaggaacgacctccctatcccgttgccgggtccaagcggggcccgagagccgccggggagagccaaagggaggggaccgatggatttcccagagtgaaactgtgcgtcctggagagttccgaggcagcctcgcgagccctcgaggaggtcgctgtcgcttggcaaacacaaacaacaataaaaggaaggaaacccaggcggcagtgcgcagaacgagcacagggtcctgtgagggcgcgcagggtctacgcgggtgcccctaacagggtcccccacgtaggcggcgcgggcacggggccgggggcgcgcggcgctctcagcgggagggcgcctggattaggggtcccgtctcccctcagcgcactcccgtctcccctcagcgcacccccgtcccgcgccaggcccacccgcagggtcctctccagcacgtccgcggccgcagcagccagcccagcacccaccttcgaagtccgaaatgatcccatccagctgcgcgttgaccgcggggtccgacatgatggctggtgggcagcgggtcgcgcggagggcagcggcgaggaagcgcccccggcggggcccgggccctgcgcgctggctggggcgccgcgcccgcgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtcagagaagccagggacgggcgacgc

SEQ ID NO: 10899 - DNA, 1813 bp, Homo sapiens
cgagtccactccaccaacgccaaacccgccagccccgccagccggctgcaggaccgagggagggtgcaaaaggcggggggcggagggggggtagatcagattaggcgaaactcaataagctcccagccctccagcccaaagcttccaccatcgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcggcccagtggctcctgcgcgccggagtccgccgcgaagactgagcggccgcggggatcgccgcgggctccgcgcgtattcctgggctcaacactgccactatctgacacaacaggagcagtgtcgggggggtactgcgcgcccagacgtgagctgtgataggctctcgaaactgggcgc

SEQ ID NO: 10900 - DNA, 1872 bp, Homo sapiens
cgtggacagaaagcacgcgcaaggggttccggggacaggaagccaccagcctggggagcgggaggcactggacatttccccgccccgcggtcggtacgggtgcgcgtgcggcagcggcggcaggggctccccgccctgcccggggtccccggtcgtgccccgccgcccgggccgcgctcggggttgattcgtaccaccttgcaaggaagtgaacgcttcgcacgggaaggggaggcgcctgcgccggccgccgcgcagctccggggacgcccggggctgccgccggctcggggccgcagacgaccgcgggacgcgcgagtcccccgtccccccttgcccgccgtcccccccgccacccttgcccgagaggagtcaaatccggcttttagagctcggggagggtggggatatccggtgcctctcccgcgccaggaggaagggggagggcggagaggatccttggccagtctgcgccgagcagattcaaaccaaaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccggtgagcccggcgccccccaaccccacgcccccgttctcgccccgggctcgcgccgcgccgcgccgctcccgcagtccccagcccgcccgcgtgcccacactccggcgcgcgctcgggcgcacagcctgagtttgcgagatcccgggaagttgaacccgccgccatctggcgaaggcgaatgtgatgtgactgttgctggtgtgaatatccgatgccaccgaacgtcctcataactgagggttattttaatttgggattcccctcccctcctccagccctccctcctccccctcccgctcccgaaataaaaccgacgggacccagaaggggaggctccccgccgggccgcccgcgcgcacccacagttcctgcgttgacataatctttagggtggagcgggagcagcctggacgcaaactgcgacgtttaggtaaacgtgcttcggaggaaggaggctgggacccggctggctttccctgttccctccaggttggcagccgcctcgcagtggcggagcctgtcgttggatgtgtgggtgtgcacctcgccggtgttgtctgcgtgctgtcagtgcagtgtgactgttgtctgtcccctgagtgttaacgaccgccgcgtggcgcgtgtcccgggcagctgggccagggtcggggtgggggcatggctgcctttgccggcacgttttgcagacattcaggtgacaccgggttgttgcgagaccttctggcttttccattccccgcgctccccaccgtcgtgtttccgcctcactcatctttagtaactggcgaagcaacagggaggaaacggacctcactctttatcggagccatgcccgcttaggtctttgctccgtgggtccctggctgcccgacttgactggcaaggcgc

SEQ ID NO: 10901 - DNA, 652 bp, Homo sapiens
cgctttcccggtggagacggcgacgtggcccacacgcgagcccctcgccgaggatgaatcaccagccagctcgagttgccacactttatctcagtacagttatcgcgagagtcccggggccgcgccggcgtgctctacgcacgcgcagtctttcgcggggccggccagtggtgccgtcgaggcggggggagtggccgccgcgccggccgagtgaggtagggtcacacgcaggcgcactcgcgcgccgacagctcgtgcaccgtgtggtagcggctgtgcgcgtccaggaaggacacctcgtcctcgtaggccgtcgggcggcagcagggctgcgcgcgcacccgctcccgccgcaggcgccgccgctggcgcagtcgtcgcagcccgaggtcgtagacgcgcgcggcagcctcgcaggcgcctgcgcagtagcggaacagcaccgtctcgtcggacgcgtagcccaggcccagctcgctcacgcgcacctccagctcgcgcagcccgcaaggccgcgcccccaaccgcgcacgcgcgcgccgccgccggggccccgcccgacggcgcggacctgggggccgcccagcccagggcgtcagctcgcgcagctccatcgcatccggggccccctgcaggagtgcacggtctgcga

SEQ ID NO: 10902 - DNA, 722 bp, Homo sapiens
cgcctcccgcagcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccggtgagccacgctccgaagagggccgcgggatggggggacccaagggaggttaggaggagggcggcctggacccagactccggcccccatagcgccccgctcgctccctaggcctggggccctgcacgcgccgtgagtgaacgc

SEQ ID NO: 10903 - DNA, 858 bp, Homo sapiens
cgcccgactcaggctccgagttctcccctcgaccctccccagcctaaaggctgtacccgcttcaggccttcccagcccggccctccagttccttcttcggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtggttagtgctattgtttacgacgtcattgtggtgtgtgtgtgtgagagacggagaccctagtgtgtgccgtgggtgctgtttgatcggactcaggacggtgagtaggggcggggtctatcgtgtgaccctggtctacggtgacgtgatcgt

SEQ ID NO: 10904 - DNA, 598 bp, Homo sapiens
cggagacacggccacacgagtaaccccagcgacgctttctccgcgcgtgtccgctccggcatcccggacactcctaccttgacagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagcgccccggaggtttctgggagtgcccgcccgcccgcgctcagtgcgcaggcgtcagacgctcagggcctgcgagagcgagctgagtggtcccagggtctacccctggcaggagagagggtgggacccgccggccaggcaggtgcgggggaggagctggggccggtgcggggacccgccggaacctcgg

SEQ ID NO: 10905 - DNA, 1281 bp, Homo sapiens
cgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccagggcccgcgcggccgcaggtgcggcgcgtgaacgtggtgctgagcggcctgctggagaagtgcttcccggccgagtgccggctgcgcaggctggcaggccaggcgcggagcctgcagcgccagcagcagccggaggccgcgctgctcaggtgcgaccaggccctggagctgggtgagtcggctgcggggcgggtccgcctcccctacacctgtccggcccagcagcggggtggggagctggccggtgggcccgaggctttgggctttcga

SEQ ID NO: 10906 - DNA, 1788 bp, Homo sapiens
cgatgcagcccggagagagcaccgcccgcgcagcgacgcgcacagaccctcccttggagacgcgctccccggcgcgtgcggccgagcccgcgtgaaatgcacagaccctccggtgaggctctgcccacgtgtgaccctgagcactgcgaagcccttcccttccatcctcgcgtggccacccaaagtcttgcctacacctcgtacgtgcagatgccaattccatagaaatacatgatgtaaggacagaaatgggaacgactggaggctgatcttctcgtgaccacgtctcgccaacgcggtgcgcccatgcacacggcgagtaaacgcacacagccggtaaacagccatccccaccatgctcagcccacagtcacgcgtggggagaaggcagcggagagggcggcggtggcaggagaagtgggaagtcgcgcgcccgcgtgggctgctccctgacagcccggcgctgccccctccccctcccgggaacggcgcccacccgggggtcgcaggcccacgcgtcgggcgcgctcgggggggctccgcagcgccgagaacgggacaatgaggacgcggtgacaggctgggtttctgccgcggtagtggcggcggcggcagctggagctgcccgtgcagcccctgccgcggccacctccaccctcgcctccccggtccccacttacgttccgagggtctctttgaactcgaagatcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagagccccagcccctccgggagctggaaacggagcccagtctgggggcgccggggctttcccgtctccggcgggagggggcgcctctgcgtggctcggaagcgccgggcgggcgggggtgcgcggcggccggatgcggggcgccgagggcggggcgccttcccgcgctgtggcctgtggcccgggggacccgaggggcaaggcgtggggtggggggggtgggggccggttgttatggcgacgggcggcggcggcggctgggatggaggcggaggcgggcgggagctcattcgcattgcaccaaatcggtttcacgtcagtttcgggacagacccgcgaggagcaagccggggagcctctgggcgggtacgcgcaggacgcgccagcagctgcctcgtggtccctttgcgagcaaaactcccgggggtgtttggcagccgcgcgggcgccctggtgctgggctggagcggccggcgggcctggccgg

SEQ ID NO: 10907 - DNA, 626 bp, Homo sapiens
cgtgaggacctccccggcaccgcctcgcgcgggtccctgccccgtgcccaggcggaggcggggtggccactgtccttccttcccgctccgcgccctcggcggcttccccgcggccccctgcgccgcgccccctccaggaggcgtcctgaccccgcactccggcctttcacctcccgaccgtcagcctcagggccgccgcggcgacgcgcgaccccttccctctgaggggcgcgggctccggacgcgccgggctctgccaggcatctagtggagggtcggaggtcggcgaccagcccgagcccagccgtcccgggagctggcgcgagtgtcgccacgaccctccctgtcccttgcgctcgcgctgcccggccgccgggcggccgcctcagcccccttatatagccctctaaaaatagctcgcctcgcaccgccttgtaaggcagcagggagatccgcagcgtgccaatccgcgcccgccgccagggccaagccccgccccaggctctgctccgggctccccattggtcctcagtgacttcatgagccccctgtttaccttacatggtcacacgcggcctaatggacgccctcctcgagatcccacggctgcgcggagaaccgaacgg

SEQ ID NO: 10908 - DNA, 1037 bp, Homo sapiens
cgggcctgacttccgcgtcccgctagcaacagtcccccttgatttggtccaaggtctcggctctgccgcccctaaaaccgtccgtaaggtccagccgcccgtcgggcttctccgctgccctccaagtttctcccaactacttgttccagaccgcgttacctgcaacctgctccgggctggcgccatactcggcgtcccggcgcttctcacaagtgccctcgcccatgaccagcgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcgttggctgcgggctctgggggttccctgctcttcccgggccccgtccctccgcactcttctggcctgactatgactcctgaaggagaatacggataactcgcgggtttgggtaggaccggcgtggcggtggagaagagcgcgtgcttttgtctgctctcagttcagttcgcgaggacttcgt

SEQ ID NO: 10909 - DNA, 977 bp, Homo sapiens
cggccctggcgctaatccgccggtttctggttccctggccctgtcatctctggcggggttgtgggccggtttaagattataagagggtcccggcgggaatcctcggtggtgctcgagggatccaggcaggccggcgattcccctccaacacaccccctgaagctaccgagacgctctgcacctgccgcgcctccagagcctgtcgtccccaggcctcagccctgaggctgcggtgacacctactgggcacctcgggccttgcacgcctcgcaggccggccgcaggcagtcggctctgctgccactcctccctcccggccgctggctggccctcctgccttggaggcacagagggaccgggcgctgaaaggtgtagtcctgtctgtggagggatggatacccggagctgaagacagcacaggagagaggggacctccacctaccagtgaaggcgccgccagggcgcttgcctccatgcctcctccagatttgtgataccgccgtgcggtccagatccccgggggcggctgtatgctagggagggagcacttcagggccctctgttcctaagggagagggacagcaccctcccgggcttccagctcccttgggtgtggcgggagagttctgggcgaggctgcgcctacacctgcacctcggccggctcctccggctgatttcgctctggttgatttcgcgcacattcctctcccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgg

SEQ ID NO: 10910 - DNA, 6206 bp, Homo sapiens
cgtcacgccacaccgagagaagcggagacgacactttcacccggtgggggcgggggcgaggctcccccagcgcggactcgggttcggggagtgcagggcgcactctctttgtgggtctccaagcgaaggcacagttcgggggccggggtggagggcgcgctctagcaggccgggcgcacgggcacctgcaggaggatcacctgtctgttttcggatgggtggcacttgttgatgtgccgcgtaaggccgggcgagctgtagaaggtggccgggcagtacttgcaggggaacacctgggcggcgtgcagcaggcgcaggtggcgctcctgagcgcccttgctggcgaacgactctccgcacactgggcacaggtggcactcggcggacgcactcaggcccagcacgccggccccctcgccgtcgccggccgcctcctggggcgccttctcgtcgggcccggggtacaaggccagtaggtcctcggccgggggcgctagcggcgcgcccttggcctgcagcgcctggtggtgcgccagcaggtgcttgcgtaggtaggcctggcggcggaacttcttggcgcagtgatggcactcgtagagcccgtcctcggagcccgactcggacacgccgccggggctcggcgtgtcccggtcgctgccgccgccgggtgcctcccgcgcctcagccctggctgctgcttctggctccggcgcgcgggcggcggcgggcgcgggccgcggtttgtgccagcggcggtgcgaggccaggttggccgggcagctgaagaccttggcgcactcgggacagcggtactccacacgcacgatgcgcgagcatttgtgctgcgccagcgcgaacgggtcggcgtactcctccttgcacagctggcagatgaactcgcccagcggccgcgccgcgccccccgcgcggccccgcggcgcctccaccgggccctccttgatcttgagccccagcacgggcgacgtggtcacctcgtcctcgaagtgcagcttgcggatggccttgggcttcttggcgcccggggccttgactgccttggcgggcggctccgcggcggtagggggcgggggccgctttcccgggggccgcagggcggcggcagggggcagtggggggccggggcccgggccgcgggccgcctcggcgccagccgagaacgccgtgcccatcttgagctcggcgggcgcgaagagcagcgggtcgccgccgcaggtgccgcctccgccagctccgctcgcgccgccgccgccgccccctccgagcagcgcggcgggcgtggggaaggactcggccgagaccggcgagcccaggttgaagctgcgttcgaagtacttgtgcttctcgtgctcgcggctcacgggccgcgtgggactgtagagcggcgcggggtgcgcagcctcggggttgccgaagtgcgcggcccgcgggccctgcgggggtggctgcggcccaggcgcgcaggcaagcgcggcggcgagcgctgcatgggcgcgctccgcgggcggcggcggcggcagcggcccggggaccgggctcggcgccgggggctcggcgcgggcgcccccgcagctgggcgagagcagcagtgcgcggtcgccgtcctcgccgccgcggacccggtaggaaacgggcgtggacttcttgctgcgcttcaccaggaagccgcggggcatgttggcgcggcccgagggcacggcactggctcggtcccccctccgcgctcggccccggcggccctcagtgcccccggcccattgcccgggcgcggcggctgcgggactcgcgtggcgccggcgacggctcggcccagctctgcgccctgcacgcgcgtccctgtccccgggcccggcagccgctcccttttaacggggggagggggccattgttctcgcctcccgcttcccctggagccaatcagcgcgtccgcagctcctcagcctggcagggtgggagggcgatggggcggccaaaagggggccgggactcgggggtcgcccggtaggtgcggcagatgtacctgagggcgcggggcccccgcgcgcgcccctggtcgccccgcccggcgccgccgccccgcccggtccaggcacacgcccggccccgcctcccttcacggtctgctgcttctctatggggaggcgcacgtgcctgggctttgtgtctctcctccggggggcgcggagccgccaaatgggcccgtccatcagcgcgacaatgcacgcccccctcccgcgcggggattacccgcgggtcgctagcaaaatagcaacaaaggagaagaatggccccaaatatgtcaggagggttcaatccgcgagccggagccgagggggaagttgtgcgcgctgattgggtgggggcgggggcgcgccggggcggtgcgggggagatcgttgcggaggcgcagtggctccgcgtggtgtttgggaaataaacaagaatccgagagagcagcagggtccggacggcctccgcccggaccttggacggatgggccgctggacccaagaggccaagcaaaagggttccccggggttccaagtgtggacagggggcccggccttctggcagtggccgagggcgatgtttgtgctcgcagcctccgcgcgcccacggggctagagaaggtttctttcgagtttgagaaggaattggcacggccttctcagtctcccgaaagcgcgggattggagcgcgggcgggctgggctgggttcccagaggaacgtgaatttctgaacttttgggttcttggaggcttgggaatggcatctttggcggggcccgacccaggccgcccggagcttccgcgtggtccaaggctcggttaatccgggtcgagttggccgaagcccgaaacgcgcggtcggcctcgtgcgccccagtgaagttggctttctcctccccgcgcggcctcatgcattttcattccgagcgggcattttgtttgccggttgacatcagatgctaaatcaagggctccaatcaaggcgctgcgaaataaaggggctgcctgtctgggcgcagcccccacggagccgtgcccccttcacctttgtgaaggaaattaacctcctgctattgagctccggtcgcggccaatctggacgcaaaagagacgcgtgctggacggggggagggggggcaatctgtactctgaggcaggctgaggcctccgagaggacaagccgcctcccctgtgccaccaggaagagacaacagcgaagattccccccgcccccacccccacccccacctccgctgccgttccgtttggacccagactgggccgcctgcctccatcctctgtccagcccagccccgaggaaacacaaaaggcagaatcttcgggggacagggcagagaaccccacgagtgcgtagtggccctgatcgtccaacactggggaacaaatagccaagccacataaaatgtcatatgctgtgaggaaaatgtcactttattgaaagagaaggaaacatttttctgcaaagctttgtataccagacagattttgctgagttttacttacgcttaattccactgaaggtatttaattgttttggattttccctctgaaaataccctggcgtagaaattaaacatgtaaaaatagagtccacatgagtcataagttgtgatggggacagttgttaggcttaattaattaaggggttaatcaggttggttaatcaagggaaagatatttgataattttatgtttgtaatattttaactcacacactgaaaagggaagaatgcatatagtgaaatatattttgaaaagtctcaccctagttttaaaaatgctgtggtgagtgctagtctccccaaaagttagaaatcttaaaatgagtttatctaaaatttataaacatatttctatctaaaagtaactgatgttatttccttgctcttttgagctctgattaatagtgctgatgaaattagaagtgggaaaaggattccgagacagctttggccaattttattttctaatcacgaatcccatctggattgtagaatagcatagggcgggggctcggcctgccccattcggtcttgcatatgtaacactccttccattcaacagataacagagagttagtcaccttgtgaatcctttaaaaataacaacacccataattgtaaataagccgtggggatgggaaaccggcacctctaccaacaaaaaaaacaaaacaactcctgcgtgagtgaattcaaacagggctctgaatttagccaagggaatctattaaacgctactgagatactgagattcaatgaatccgtttctttttctttatttgtggcttccagtcttgctagcgtaaatgaaatctgctttcagacgggtacagtcaaaataaatggaaacttgaaaggtactagtattggaaactaatttcaccacccggggctggaaggagttaggctgcgcacgcgcgcacgcacacaccagcgacctccaagcaggtgtagcccagcccgggccgtggatcgcagccgccttctgcgtgattttctcagaacctgtgcacccgcatgcatggggacatcgggtcgagatatttgtcttcgcctgggaagagcaaagcgccatcacagtgcgcccccgacgccggccttggcgcacgcgattcggagaatgggccgcgtgaagttaagttgggggaaacagcgcggatttgcccccctccaggggggcttcgcgaaagtcagtgaacataaggatccaaggcagagcacccaaggggccttccccggcttcaggtgactcctccccttccttcggggtcctggccagcgctttggaaaaatcccgggcctcttcactttcccttgcggaccccgcggtgggttcttcctccgacgactgcggagcccgaggccccaggccctccaatttctcctatcctggtgtgcggggatgccgtcggggagcgcgccggggttcactctgaccctcaccacggctggaaatcaaagtcaaggcaacagggagtttgtagaaagcgcgaagcttggaaataagagcagaagcggggaacttctgcggaggagttggctccttggggtgtctaggagaacaggaggccctggcctcacgggaggagccgggcgggcccgcattctcaccccgcagagggtatcgcgtttggagacgtcggcgttgggggtgaggtgtcagcgcccctcatcaccactctgctgcagacttctcttctggcttcacagaagcccccactcccggccctcagtcccccgagccacaaccggcaggaaccgtgcgttaccgctgcagtgcccgccgcccggagggaccagcgcctccctgcgccgggtgcgcccgacccgagccggtgagaggctttgtatttgcaggaatgaggggttgttgtgtcagtcccaggggcacgcgagagacacgcgcagcccgcctggccgccaccccgcccggcccggccccaggcaccttccgggcctcccgcccgcgggccgttgcctttgttcggcgcattagcataaagctgccagggatctcccgtttagataattccacacaaaaggagagtgcatgaaagagagcgaacaagggacgatccgcgaggctgcgtcgtgcgtcctcgcggggagggaccgcgctcaagtatttccctcccctcgagtttcaagtgccccctggcaatctgctgcgcgcccattattcggccgggggccgacggcgtggctggccacctcttttatccccccgagagtaccgtcggggccactgcacgctccttgaagtgccctcagggctgtttgtttttgcctcagtgggaccgtcgggccagggagggaggagagcgggtaggaaggcccgggcgggcggcgggaagggcgacgtcggcgaaagctggcagaggcgaagcccagaaggtgagaaagtcataaccaaagaattaggtcagggagagtcaggacggcacgggacccatcgggatgacattgaccttggggcgcaagaggtgtcctccacctgtgaggtgctggcggccgctagtccgtgcgcctcggtctcaaacggaactgacaaaacccagcgaaactgaccagaaaggctgcggcgaccccgatcctttccccttcctcccaccccactcacacctgcaccccgcctcgcctgccgcaggaggacga

SEQ ID NO: 10911 - DNA, 574 bp, Homo sapiens
cgccagcgccaacgaatgtggggacagttcgtctggcgcccgcggtcgcatccccatcgggcagttccgtacccctcctccgggcttccaagccgctcgccccggctgcgggagaccccggcgaatcacatccgagaggggggcgcgtggggcggagccttcctcccactgtcctcccgccaccagccgcccctgtcgccgagcccgcagtcgccagcgcgccccgagcccctccaggccagaggctcccgcaggcgatggcggacaagagggcggggaccccagaagccgcggcgcgcccgccgcccggccttgcccgggagggggacgcgcgcacggtccccgcggcccgggcccgagaagctggggggcgcgggtccctccaccccgcagcgggccccgggaccgccttcccttcccctgggcgcggggaagcggcctccacggcgactactccgagcctggaaaatggccgggtccgggacgaagccccagaaacctgtggtgcagaggggctagggactcgggcaggagccagcgagaaggccgaggacgcgaacaaggaggagggcgc

SEQ ID NO: 10912 - DNA, 3438 bp, Homo sapiens
cgtgcttgtcccgccctggccgcctgaggccggagccatacatagtctgcacagatccgagacacccggtcccgagtgatctggaaacgagtgtgctctcactgcgttcaaacaagacgaggacatttacaaggtgcgagtccccaacccccagctactggcaggggctgcgcagcggcaccgcccaggctctctctccaggcggccgactcatttctgcggagagcacgcttctcgaagagggttgtagacgcgctcttccagcatttaatttgccaccccacaagattgagttaagttttagttaaaatacactcattttattaaaaataggcggcccaataccacgccgtaccccagcctctccgagggcgcaagagaatagagagttttcagattaattggaggcaaatattttaccttctaacatttaaaaataatctaggcgcgtctgcaccggtgtggctcacgcgacccctacgcgcgaggtcagtcgggctggtccagcgcagacagcggccgggactcactcacccagtgcgcgcctctcctgcctttcgctgcgcgcgcccaaagctagaaagaagaaggtgacgcgggaggcgggtcgggtctccgggtccagcgaattcgcgatctatccggtttcggcgcctgagccgaggtctcagaaagaacccgttaattctagccatcctggatctgggtagggagggtgcgcggctcccaagcccagtctggatgcctagtgcggtgtgcttcggtctccccgtctgccctccggggaggtttctcacccggtggccctgggccgcttcactgtggcgcttccacttttggctaccggccttcctccgcccaggaccttccggcccagggagcagccgacgggcacccccgaacgctggggcacggaatttcaacggggcgaccagagcggagctcgcggctcgaggctcgcggctgagtacgaagacgggacccgaggacctgtacatcgctcgaggggaacctgtcctgggctctggtgcacacatagtatgcgttctgggctggcttgggttgggccaggtaggggagacctggctgggtacgaggcgccgtccaagccttccggccgtgggccgggcggtcgcggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcga

SEQ ID NO: 10913 - DNA, 4088 bp, Homo sapiens
cggcccggcctggcccgggacacgtctgctccgcgcacacacagtcagtcggtcctgcccgaaacgcaccaagtcgcgcccagcggcaaccgccctccctcctcccctcgccgcccccctcccgactccggcgccacgactcccttgcgccccctcccccccactgcaccacctttaccgctccgatcctttccgaggggctgatgtcaccagcccccccactctcctcggccacttctccccgccaaagcctccctttggcgaggccccctccgccaccacggcgccccccagcgtcaccccctcctctcctcgcccctttcttcccctctttccctctcccaacaaatctcacaccccacggaggcgggtccccctccctctacccgccacccggtttcctgtccccgaaaccctctttttgtcgcagtctccggagccccatgggctccccctccccctccccaacacgcacccaaacccctggcgtcgtgtaggcctcgcggaaaaagagagaaagagagaaagagggggagagcgagagcgagagcaagagagagacactgagcgggcaggccgggggagggggacccgcgcccgcgtcgccacggccccccgccccgtttttgagcccccgcccggccgaatccgcgcccctgggtcccccttccggcctcgccccccacagacagagcccgcgaacgggcggggggctcgggagcgcgcgcccggggcggggggcgggctcggcgcgcgcggcctgcggggcgcccttcgagggcccccgggccggggccggcgccccccgcccgcccttacccagcagcagcaggcggtgcgtggcccggtagacctgcttgtccttctgcagctgcttctcgatctttttgttggcctcacgctgcgccttctcctcgttgcgctggtcctcggtcttactgttcccgaggcagcccatggcggcggcggcggcggcggggcgcggccgggctgcggcggcggcgggcgcgggcggcctcacgcgggccgggagggccggggcagcgccgggcgggcgggccgggcgcgggctcggctcctcggcaaggagcgcgcggggcggactgcgggccgcgggccgcggggcgcgcggacgggcgggaaggggagggtgtcggtcggaccgaggggcgcgcgcagctccccgcccctcgagccgaggccgagggggctgatggccgccgccgggccgaggcggaccagagcaggagctgcgggagctgctgccgccgctgccgccgccgccgctcttattgcctcggccgggcccccgccgccgccccgagccaaaagcgccgcggcgggcggggggaggcggggggaggaggaggcggcggcggcgaggggggtggaaggaggaggaggaggaggagggccgaggagcggccgcggcggcggcggcggctgggagggcgggagccggcggagggaggcggccccccgggagcccggggagggggtccctccgcccgcgcccggccggggacgggacgggccggggagacgccccccaccccccgggctcgggcagcagcccggctgagccgaggggggagagggggcgtctccgcgccagtgacgacccctcgcacgacgccaacgctccaccccccggaccgcgtcgcccggcgcccccgaggcctcctccccctcccgcgggcgccgccgaggggctggggtgggcggaaggggagggagcgcgcgcccggacttaggaaaattttcgaaagagcgagagacacagagagccagagagcaggagtgtggaaaaagcgaggcgagcacgaaccaaaggacagagcaaccgaaaaggaaaatgtgtccacacacacacacgaacacgaataaaaacccacactacacagcgatggtggtgtctggtggcggtggcggggtggggggtctgactagatgagccgctcctcgcgcccccggcgccgggcgccatggcccgagccgaaggcgcctctggccccggagcgcccgcggcctctgcgcttggcgcggccgcccaagtaggagaagaaggcgcagcccaggaacactcggaagcagcaggtcgccccgaacacgaagccgcagccgcggccctgctccgtgcgcttctgcagcaggaagttgagcacccacgaggggctgcgcaccgagaagaccaggaacaccacgaggggcaggtgggcgctcagcgcgccagccttgagcggcccgggccgccacacgatgcccccaacgcgcggcgccgcgtagtaggcgtcgtcctcgtcgctcgagtccgtgtcccagtcagcccaggccctactcgtgcccccggcggcggcgccctcctcggcgcccccgacggcgccctcctcggcgccctcgtcgtcgtcggcggcggccgcggcggcggcggcctcggggcatcgggcctcctcctgggcttctggcaccttcttcttcttcttcttcagcatcttctccatcttcttcctctccttctccttcttcttctcctcctttcgcctctgctccagcagcttcttctcgagcttcttgcgctccttgtctgttaggaacttttcggggagcgcctcccgcgccgggttcttggggttcttcgcgagcttctcggggtccccgctcttccgcggcgcgagcggctctctcggctcggccaacgccgcagccgccgccgcagcttcggcagccacctcggcagccgccgcggccgtcttcttctcgctctccgccgcccgggctttgagcttcatggccatcttcagcatggtggcccggccacctcggggagctcggctcgcgcctggcccgggctccctgcttgcccccggcctcgggctgcccggcccccgtgcgccccgtgtcggggggcttggctgcggttcccgccgcgctgccccggggccgcggagcgcggctgcccgggcttcgggctgctgggctggctgcctaagagttagcgccaaaaaggatgagcaaacgaaaaagggacaagaacaaaccaaaaagcacccaacaacagcgagaaaccaaaaagcaccaagaaatgtcaactcaaaaagaaaagtgcaaaggcgcggatggcaggagtctgtttaccctcaggcgctccttggtttggctcttgggcacgccaatggagaagagaaaagagagagaattggggggtgcccggaggcgccccggggcaaggcagcggcgcccgggcgcccctgccttgtcccggacccggcggctcttgcctgcgccgggcgactcgcacttccgcgggaggccccggcgctccccgacttacatgtgagtgaggtgcactcacacgcaaggcagcgcctgccggccgcccgccgccgccccgcgccgggacaggggctcgctccagccgccgcgccgcagcccggagccagagagcaggggagcgccgcgccggccagccacctgacgcagcccgctccgcggtgccgacgcgactgagtgtccccgccggggagcagagcttctaaccggccccgatgacgccccagcctcttcagaggaccgacccatagcagcggcccctataaaccgaaggggaagcgcgaaaaatcggcccaccggggacgcacccaaatgggccgccgcgcaccctgggggtgcaggccggtgccgggaccgcgcgggcgtgggccgggggcgcgggggccgcgatggcggggggcgcgggcgcgcccaaggcggtgggcgctcaaccccgcctcccagacctgcctcccaattttcggtgagtggtgtagccctgggcggcgtgcaaagtgtgcgacggcggcgcttacccctgctgtgcgcctccttacctccagccacccaccccgccctcccagcggcgcgcgcccgccgaggtaggtgtcagagagccgaattcgaattatttgcgacgcccggacggagtttcgtatcttcggacgagaaaagtgcgatgggagtgcaaagcctcccctgctcgaagcagcaggcgcgccggtgtcacgggagccgaggagcggtggccgtggctgtggagtcggtgctcgaggcgt

SEQ ID NO: 10914 - DNA, 522 bp, Homo sapiens
cgatacagcccccggcgcgccgggcactgaggccctggagcacagcgtggggggcctggcacagacacgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccgg

SEQ ID NO: 10915 - DNA, 2260 bp, Homo sapiens
cggcatccgggccgaagcgcctggtccgcgtttccgcgcgggctcccctggaaccgtcccgggacacgcggccctctcgctgctggacttttccccgagccccagcttgccaggcagggactccctgggcgggcggcggggaagcgccgagtcggcggccgcccacacccctctccacgcagcacaaaggacactcgccggcaaactttcctcgcttctgacccgggccgagccgggaactcagcgccagctctgttcctggcggggctgaggcttccctcacattccaggccacctggcaaacgtcctgaggctgccactccttctgggctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggaccgccgagagttcggtagatccttcccaaggctctgacttcaatactttcagtgccttgtcaattataccccttgcccctttctcttaccaaggccaccgccaagacaccctttttctttcctctccccgtcgcccgccaccttccttgccctcctcttggccctctttccagctccctgggccccctttccgcgctgctctccagccccagctgccttccccggttcacatcccggcagccctcctccctccccgtccccgggcacctccctcccctggtcggcccctgaaatccagcaggctcggctccggtcactgcctttttttgcctgtttctatctggcctgccttcccaactatcgctctcccacacctttttttttttttttttggcaagggggacggggggaaacggggcactatattctcgtttcccgacttcgtcattttccccagctccgtgagccgcgccccctcgtccccctcaggcccgcgatcttaccctgaggttccccagaccccgtagggtctcccacgccaccaagtttgcctcgacttcccctcgctgcctcccacacctcctgccgcggcgcggccggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccgggccggtgtccctgccgcgggaaggaggattcggacgcttaactcagcggcgaagtcgcttcccattggaggaggctttccgaaaacgt

SEQ ID NO: 10916 - DNA, 1502 bp, Homo sapiens
cgacggtgagcgtggagcagcccgcggtctcgctgcccccttcactcccggacccccagcctccccagagtggaggggcaagcacacagtaagtacttgatattcgcccgactcctgagctcctcatctgtaggagctagggggcttgttctccgtacgtcctttgttggagggaggaacgagggaaggagaaaacccacgctgaggccgttggccgatcactttctttacctcccggacaacattgatgggccccactaaggaaagccgaattctcgcatgcccgaggagtgtcggaggtggttgtgcgcctagtccctcctggtaaagggttcgaagcactcgtttattcaaaggcggccgagagccataccatttgcttgcatgacgggagacaccgaaacgccccttttgaacgcgatgacaaacacctcctcccactcagcagcgacgtgcacgtgacagtttttgggctctcgcaactacgtggaaacttggaataggtctgcggctgcacaccgcccggacgccggggttcctgcgtcccccgccccctctgatcgcggctgggtagccgagccgcaggcagctgggggcccccgaacgccgcctctgcatcgcgccgcccctgccccgggctccggtagctttcgggcttccgcactgcccgccgcgccctgcccacagggaagcgcttccccaggcggcggcggtcctggtgcggaccctccggccgcagccatgtgggacccgcgggcagctaggtgcgtagcggcgcgggaagcactggggcatctctggccttccgggcccgccacccttcctggcgggaggcggccgcgcgcggggactggcgaccctgaggtagcggccgaacgggcccgcccggccatccctgtggggcccacagccatctaggtgcagacccgagccagttgcgcggggtcggtcgcgggggacggcttcggccttttcggtccggagggaccagggcacgcgctgcgacaggactgcggcggcgcgcggcctgcctagctcccaccccggcatcgaagccgcagctctcgggcccacctccgcatcctcaggggttcccgggggctgccgacaggttcctgaccagcgagcgcgcccccggggcaagcattcttggcgggcagaaacctgggagcggagcacagcggtgcaagggaaccgtgccaggcgggaagggcggaatttgcggggaacttggagcgcgctggcctcttcccggcagtaggaggccttcttccctgcccgcccgattgagggctgctgggctggctcaaactggactgcacggtccatcagcctgggctcaccgagtctagggggaaggtagtagtagggacccaaggctgggaagcggagcccttagaagcccttgcttctgcctcggagcgtttccgaaccggagctcggagtctgttgcctgggaggcgcgttgcgtttcctcccaactccctgtctccgtcccgcgg

SEQ ID NO: 10917 - DNA, 510 bp, Homo sapiens
cgtcccttgtcgggagtcactcgtcagcttctcttctcagcccggctgcgcagcgctctcaacccaacccctggactcatcttcgccccagcctccttcgtgcccagcgtcccttgtaaatgacccccccggccgggtgccccgctttctctctcggcctcttccgcgtggtctgctctccgcccgcctgcgctcgcccggcctccctgcctctgcgccttcacctgaccgcaaaggcggccagggcagcctccgcgcggcctgacagtcacggctcccagtttgtccctggacgtgggaaactcgggctcatagcgcctctacgtacactgcggcacagactggcgtttcctacggcgccttcactggaaagcgcccctgtggtcctggggagagggcggctccatccgccacccttcccggagctgcccccgcccattctcatgggaggaaatcgcagggcgtgtgagcccccgacccctcgcccccacctcttccaggaccggccgc

SEQ ID NO: 10918 - DNA, 940 bp, Homo sapiens
cgggcaactgcccgggccttgcccacccctcccgcgggccgcacctgccaaggccgcaccgccagcgccccctgccgccctctctgcacagagacccgcgcccacccccgcacccgcacccgcacccgcacctgcccccaccccgcgctcgccccgcgccgaggccgcgcagcctgcgggcagtggcgggggcacgaggatgcgaatccaggcggggccgggagctgggcgcgtcccccagaacccccgccacggccaggcctgagcctcacctacctacgccgtatttctcctcctccgtgggggtccacatggccgtgccgggcgcggccccgcgggcgcggcgaccgggcgacaacgcggcggggacggccgcgggcccggctgtggcgcaccgcgagtcgaggcggggacggtcaggcggcgcggggcagtgggcggcgcatccctcacaggccgtccgggatgccgccgccacccccgccacgtctggaccgcgaggctccgcgggtggcccagcagcccctggcggcgcgggcgaaggctcgccacctgtccgtcgccgctgctcccgtgccgccgcttgcttcttcacagctccgccgcccggctcccggcgccgccgcggctcggctcgccccagcgggctcgcaggacgcccgcgcatgcgccactccctgccgcgcaggggctcgcgctgcccgggctcgcgccgtcccgagcccgcgcgcgaatccacgcgccgctgctgcgcgccagcggagggaaatccgcgagaagctattggactgcccggccccggaccggcttctagaatcgctggtccggggccctcagctgcagcaaaccccggagggggcgaagccggtcaggtgggcgactccctctacccggactccccactcgcttccgcttccagtgcctcctgcctgcgccccga

SEQ ID NO: 10919 - DNA, 2718 bp, Homo sapiens
cgtccgggccgccccttctgcccagccccgagcgcggagctgtccaggattcccagacgggtgcgagtcactgcctgaagccccttctcctccgtcggaagaggatgtgcttaaaggatcgccggaaatcctggttgaagaccgtgtagatgaccgggttgagcgagctgttgcagtagccgatccagaagaagaacttgaagagcgggccgggcacctggcaggcctcgcggcagatgccgtacaggctgtagctgaagaagaaggggaaccagcagagcacgaacacgcccatgaccacagccagcacaaaggtgaagcgcttctcgcgcgcctgggccaccttgcggcggcacacgctgctgcgcgcccggcgccggcgcgacaggaagaactcgacggagcgcgagctggcgcgcgacaggcggccaccgggccccggggacctggaggcggtcagcgcccccgactcagccgcccccggccccgccccctgcccgtccgcaccgcccgcgcccccctccgcgcccgctcgccgccgcccgccccgccgcaacgcgccccggcgccgccgcctctcggccgctgcgctgctctcgtccggctccacgtcggcgggcgggggcgcgcagtgcccgttctcgcctgcgcctgccgccgcgcccagcccgttttcggtagtcggggacgcaccgtcggggcccacgggggcgcgcttctcgctgagcgtgcgcgtgcgcagcttggccactcggtagatgcgcgcgtagaccaggcccatgatgaggcagggcgcgaagaaggagccgatgcaggaggacaggatgtaccaggtctcgtcgttgaggccgcactgcgggtaggcggcgccgtcgggctggcggtagagcgagaccagcggcgggaaggagatgacggccgagatgagccacacggccacgatggtggccttgacgcggcgtggtgtgcgcttcaggttgtactcgacggcctgcgtcaccgaccagtagcggtccaggctgatggcacacagatgcacgatcgacgaggtgcaaaacagcacatcgagcgccaggtacacgccgcaccacacctgcccgaagtaccagtaggccatgagctcgttggccaacgagaagggcatgaccagcgtggccaccaggatgtcggccgaggccagcgacaccaggaagaggttctgtggcgcgcgcagcgcccggctggtcagcacggcgatcaccaccagcacgttgcccaccacggtgaagacgatgaggaagcccaccacggcagccagccctgccaccgcgcccgccgagtactggccgcgcggcggcccccaggaagcccccgaggcattggcaaccccgccgctgcccctctcgcccgcgccgctcgcattggggcccgccgctgccgccaccgccagcgccgccgccagcgccggggacgccatggtcctcccgcgagctacgccgtccctcctggagccggggcgcagccgcggcagctcgggcgccccccagccggggtcggcgcccgcatcgccgcctgctgctcgggcgcgcccgccggggaccgcggcgcccagcagccggccctcggccgtggtggctccgcgggcggcgcgccggagagcgtggctgccgggctccccgcagctgccgagcgtgtaagtgcagagcaggaggcgcccggagcgagcggcgacgcggctgcggggggaggggggcaggtcccggggtcctcgcgcggccccgccctcggcccggctcacggggagcgccccggcgtcgagcccacggcgacgcggcgcccgagcgggcgtgcctgagcggccccgcggtcccggagcccagccggggcgcaggcgacaggcggcggcggcccgggcgctccgcctcccatccggccggctagggctcggcgcgccggggcgccggccgccgctcctccgggcccccgcgcccgcgcgctccctccgtctccaactttactttcccgggcggggcgccggcgccgccgcgagtcctccggctgctcccgggcgcgggcgccccccgcggtccacgcttggccgtgcggccgccgcctcgctcgccggagctgcgccgccgccgccgccgccgccctgcgctgggcgcgagtgcggccgcctgcgatcggcttccaacttgggtcgagttgcgcagcggggcgggcgcgcggggcggggcgggccgcgggccctggggagctggccgggaaccggagcccgcggccgcctggtcgaacctgcccgcgcggcgccggggaggagtccggggcggcggcgcggggcgcgcgctcggcgagggcgccccctccagggccgcctgcagcctgcgggacggggccgagcggcggccggcctgggtggtgagttccagaagctgctctttctaagactggagcctccttcgcctcccccggcgcaggcatgggcgcaggcgggggcgcgcacacgcgcgcgcgcagcacgggcggctcggggtccatggcctgatggcagagcaacctctcgcagcctgggggaggacgcgacgctacctgcgtgcgcacaggtcctgccgagctcagggtccggaccagatcctggatcggcgctccccgtcagagccacctccgcacccaccccggcctcagttccctcggcccacttcccagcgctgctggagcatgaatcataactaacggcgg

SEQ ID NO: 10920 - DNA, 2661 bp, Homo sapiens
cgcgggcaaagcgtgcctttcggtgggttataagcagcgcccggtccttccttctctcgccaagttgcctgatccttccctccaggcgcgcgcgcacacaccacactcacacaccccaaaaccaagactcgtcctacaggatctgggaaaagaaaaagaaaaaaaagccctcaatcaccacctccttctcgccgactccccctcaccccccgcctcccctccagcgggcagccaaggagagctagaggcgggggaggggagagggaggagaagcgacgcaagtgggtagcttttcagcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtgagcgggccgctgccccagttccgagaggcgtggcgggtccctgggaaactcagagagggaggaagggaacgaaggcgcccggccgcccggctgagggtcccgagtagatccctcgtttgttttggggtgtgtgcgtagctgggcccccggtccgcagtgtgtgtgtgtgtgtgtgtgtgtgtgtgtgtgtgtgtgtgtgtaggatgggaggtagaggggcagggtaacttattccaaatggatcagtttagggggttcggtggctgaacggttggttcgcgggcaggaacccacaatgtttcgccttcggtctttttgttgggctgaggggtgccgtgctttaaagcgagtagggctgaataacgctactgataaattcttccgtgggacggaaaacaaagtgcacacgctatctcttggtagatgtctctgcaaaagtgcgttaaaccaccaaaggcttaggtggagacgagcagagccacaggcgggaggaaggggaggcgggcgtgggctggggcaggcggggccgtccctaccaccggtgagccgggccgcggggagcaggccggccgatggggcgcgcacccgggctgcgggggcggtgcggggttcagtccctgcggccccagcgcctgggctagcagctgggagctgtgggtgcgccgagccgacccaccgcaagggtacaccctggctgtaccgcccccaactctagttttctccaaccgccatcacttggaaacaaacccacaacttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtgctggctagagaaagcgcggagcagggccgcgc

SEQ ID NO: 10921 - DNA, 801 bp, Homo sapiens
cggttattaagcggctcccccgtgagccccgcccaatgcctgtgcgctcaaactagcagcgtccgaggaacgcgttaactgggagaagtgaactgagggggtccggcggccgctgaggaggggagcgcgcgggaggaggggcgaggagcccggaggcgggcgcggctggcagcttagagggcccgggcggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcgatcctggcctcctcgtaagctccccggacccgggcgtcctcggtctcccctcatctactcttctgtcgggcaggtccgcgaccttccgcctcccgggccgtctcccgccgcacccggccctggtacatccccactacccagtccgggcccgtcctcgctctgggcctaccccagcctcccagcgtcgcctgctgacggagcgcgggagccccaaggggccggggtcacccggccggcgtgggtggtgccaggctcgggccacacctcggcaccggacccgagtcccccagcttctcgagcaggatccggaggaatagaacgtcaattttcctcgc

SEQ ID NO: 10922 - DNA, 311 bp, Homo sapiens
cggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgggaaacgttccgttgggcgctaagaacggtgcagcaactgaaaaaccgctcagtgggcgctactggcaaaagcgttgctgcaaaaccgccagctccgcattagaagcagagccgccagacagaacccgggacctgaaaccaccgaagcggagaccga

SEQ ID NO: 10923 - DNA, 1048 bp, Homo sapiens
cgtcctcgcaaatctcccgggctccacgccctgcggctatcacgcctgacagagaaacaaccagcaccagcggctgacccggctgcccgggccctcgtgcaggcgggcgggagcggacaggccctggcacgcatgcgctcggggcgggactgcgccttaggcctgcgcgttgccgctagaccagcgggggggcggggcggcggcggacacgcgcctcaggcggcagccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggaggtgagtgccggcccgggggcggcgggcggtggtcgctgcatcccgcgtaggcggcgggactagggttcccggccccggctctggccctggctctcccgcgctgcccggccgacagccccagccagggtcgaggcttccgtcgtggacagcccggcctgctcccgt

SEQ ID NO: 10924 - DNA, 301 bp, Homo sapiens
cgggaagcagcaggcgcacggccgtctggatctccctggaggtgatggtcgagcgcttgttgtaatgcgccaggcgggaagcctcgccggcgatgcgctcgaagatgtcgttgacaaaggaattcatgatccccatggctttagaggagatgccggtgtcggggtggacctgtttcagcaccttgtacacgtatacggagtagctctccttgcggctgcgcttgcgcttcttgccgtccttcttctgcgccttggtcacggccttcttggagcccttcttcggggcgggagcggatttcgc

SEQ ID NO: 10925 - DNA, 1395 bp, Homo sapiens
cggccctgtgaggcccacgcgggagcgcggaggctcctgggtctcagggcgccggcagatggcctgcagcgcaccgcccggcccccgcgctggccacgtccgccagcgtcatctctctcccccgcctcctacccctaaaaatccggcggtcgagtagctccgcatcccggagggctcccggtgcaaaactgagtgggaaagagaaaggggcggagagcgacgagagagggaaggtggggaagaagagcccggccgcccccggccttttccggcgagctctgagtttccagggctcatccgcccctccaagtcgaattacagaaactcctcattgccatgctaatgacgagaggggctgtggggagagggtttcgaagaccctcctggaagaagggaagtttcttttcttgccctcgtctccttcacgcccacccgagttcctcccagccagccctctgcgctcttccccctccattccgagcttgaagagccggtggcccagcctcgccctccaccacggttctatgcgctcctcacagccccacggtctcccagcccagcctcagaacagaggaggtggcctgggaacccggggcgcggtgtcagccggattccccgccttccggctgggcgcgctgcgggctgggccggcgtacttgcggccacccggcgagctctggcccactgattcccgccccgagagagccgggagccctcttcccttctcacctctcgccagttcatctttcattgaacggtggggagggggcgggagcgggggacgcctcccagcccccacctcccggaggcctggcggggcgggcagcggagtcgggcgcgcgcagaacgcagcttttgctcttcttcgctccagcactccaaatcggcctttgcagtcgccgcagcagctgccgccgcctaggctgcctgggggggcgactgcgcgtcacctagacggcggagcgccggggatttaaatgccactaaaacggtgatccatcactgcggaagccggcaaacttttgcaggaggctcagccattggctgacaccgtcacgtgcccctcctccagcgtcctccgccctcccgccccccctcttgcgcactgtacattcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgc

SEQ ID NO: 10926 - DNA, 766 bp, Homo sapiens
cgaccccgtcttatgtcggtcgcaccgtgtccctcccaggctccactagcacctgggctgctatggtgagatcaagatgggccccgcccacaactaacgatgttattccgcagcgagtcaaagccactccctaccctgggcccgctacgcgacctctgccggcctccgccccacgcggttttagtacggcgccaaggccccgcccacaaatcggccccgtcccctcgtgtccgggcccgccgctcatcagacgccgttccggcgcagcgagttgagggcacgcctaccctccctccgggtccccagtcctcaaggtcccagcacaatgccccaggaggaagactccaggccccttcctcacccgacgctgtttctgggcgagccgaggccccgcccacccgccggcccggctcccgctctcacctgacgctgttcttgtgcagcgagtctaggcccgcgcccgcagccgtgccaccctcggagctcgccttcttgtccaggttctggaagcgctcgcgggccgtcaagccacgctgcgagctctgcttaggaacgtccagccgcccgccgaagctcagcatccccgcggcggcgtcataggtgaacagcaccgggaagcagtcgtggccctgcgcggagggcgggggccattggagcgccgcggaggggaaaccgaggccggagggaaggccaggcgggcgtctggccgcccgggaggcagatgccagctcaaggatacagacgggccacagcgagggaggcccga

SEQ ID NO: 10927 - DNA, 691 bp, Homo sapiens
cggcgaccagcccccgcagaggcggggtccgagtccccagccagagccccaacaagcagtcgaagaacgcgggcagaggctccgacatggccaggagagcacgccgccgcccgtaggtgctcgggcctcgccgagaccgggaagaggtggcgccgccagcttttcccagacccaggggtggcccgacaggcctaaccccgctccccgccctgctcccccgtcccctcctccggcgacgcccggcccgcggttggccggcccgccgcgcgctccgggacgagggcgggaggcgagcgcgctggccgccgcgcactcaccattgtcaacgccgccgccgcgtcccccctactccactcctcttccctcaggagaactcccagccccggctccctccgctccggcgctccgtcacgtgacctcgggccgcccctcacacgtgaccgctcccttcctctcccccacccccgcacccgtccctctcccagcctcctgccccgccctgctggccgccaggcactccggggagaggccgcttggaggcggggcctcaggctccacccttcggagggtggagaggggcgggcaaattacgtcgagtgggcggggcctgaacagaggcgggttcgcgggctcctcctcgccgtctcttcggtcaccggacgagcggttccgtgtccggcctctttaccgc

SEQ ID NO: 10928 - DNA, 1024 bp, Homo sapiens
cgcgcactcaccctgggctgtggagcccagctggccgccgcccgcctcggccacgcgctgcggccccacgggcccgggagcgagggcttcgcccgcgccggacatgggccgctccgccgagcccgcgccgcgccgctgccgcctagctcgccgcccggcagggcgcacggaggaagggctgtgaggtgctgggtgcagggaactgactgcttctggcggaaaaatatacaaaattaaaaaaaaaaatgtttttagagaagagcacaccacccctgcgggacgttccctccccctccacttccctccctcaaactccaccccggggaagttttgatttgaaacttgcgaagaaaactgttacagcgcaagttgacagcggcggggtcccaggggtccgaggtggacccagcggggaggggctggaaagagagatcgggtttgggagaaccccggggatggggatcaaacccctcctcttccccgcccggagaccactacctacctccgcatccccccgtagtcgctccaagccccttcctcctcctcctcctcctcttccgccccggaaagttagcgagcctccggcagcggccgcattttcgccccggtggcctgacgacggcggcggccgcccctgcgcgtcctcccgcctccctccggctcagcccagacgccgcagtggcggcaactgcggcagcggtggcggctctgactccgcgcactccgccccctctttccagccagctcactccagccggctcccctgcgagggggccttccccctctctgcctctctttcccctcttccactcctacaatcctgaaacacttctccctctgttgctctttttcatcacatccggatcgggaaggcctcgaactcttggctagcggccccgatgctgggagcggcgcgacccgggctcggccgcgcgatccctcgcgccctgcgctgtctgggtcaggaggccagagccggcctgggctggctcgggctccccacccgggcgctgcgccctcccgg

SEQ ID NO: 10929 - DNA, 1339 bp, Homo sapiens
cgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaaggtacgagcggggaatcagagcacagggtgcggaccagaaagagcagacggtcagtcgggcggggaaggaagttgccgagttgcaggtgtggaaggggctgccccaggcccacccttggcagacgagggggcggggagtcgcgccggggacgaggagactgcggaccgggcgcgctccttgcgcagtcgctcgcccgcgtgcccaagccccccgggaatggccctcgcccaggggcccagctcgccgccgctagccccgcagagcctgcagctgctggggcccggcagccgccagggggcgggagctgcgtcgcgaacaatggccgcgcttggtcgcgggccggcgggaggcggagtggaggtagagccggtgccgggcgcgcgcgccggccgggcgtgctggggcgcgggagcggctgcgcaggcgggggcgcgcggcgcgagcgcgggagggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaaggtaaataccctcatcgggggcgtccgggagaccccgacttccgcgccgccggcgaagaaggcagagggcgctggggagccctgcagttccgcagcacggggaacccggagaaaagcagcccccttcgcggcctcccctcccccgcgccttccctcccacatcgggctctcggggcagcagcggggaggggagaccggcgggggagggaggacagggaggcgaaggaattggggtggggggtgcgtgtgtggtggagggggtgggacgacacaggtgtcctgaggggaggagccgggaggaaggcgaggaggccgggccaagtgggggtgcggaggtcggggagacaggaacgcggctgcgggcgcgggaggctggggttctagggggccggggtggtagcggccggaagagaggacggcgagtgcagccacggtgtggctgcgagggagagggagcgcctagagtagggcaggggagggcggcccggggagggtctgcgggaaatgggcctgggggcgctggaggcgg

SEQ ID NO: 10930 - DNA, 2273 bp, Homo sapiens
cggcctccagggaccgaggggtccgcagagtgacccatcccatccccgggaagctgccgggagccccgcggacccgccgcggcctccagcctctatgtgcaggggcctcggggttggggcttggccagtgcgacgccccgcccgcggccacctacagttgttgaggaacagcagcaccgcgaagccgagcgtggcggtggccagcaggatcaggcaggcgttgcagggcaccatgaagcctcgcaccagcagggaggcgccaggcggctgccgggtgtcccgcgccagcggcagcggaggcatggcccggggctccggctctgcgccccactctcagagcgtgggggctcctcacggggtgcccttgggcctcttcagggctgctcgccccatcctgggacccctggggcggcggacagcagctgtgccctcagagttcacccagtcacagccctgggggtgccaggtcccggctccagtcctccaggctcatcgtgggaggagggcagaattctcccggagtagaaatcccaaatgtgggctccgaggtaggcggaggagggactgggagcccgcagccacccctgctgcccacagcctccccgggctggccgccagcgctcggtcttcccggagcccccggagccgcgcaggccggagaggcggtgcgcgcggcaggtgcgcgggggccgggcgccgagggtctgctgtccccgtccccggcagaggcggaagcggcgataggagcgggcaggcaggaggggcggccgcgtcgggagcgagaagaaagcgccgcctgcggaggccgcgccgggtcccgggctccctccagctcccctcgtccccgcggggctggggaggtgagtgaggggcgaagacgccgcggagggagggcgggagcagagacaaaggaagccgcctccagggaccccggcgtccgcggggagttccagaggatcgggcggatgcggacgggagagcgccgcacaaaagggaacgccgggcaggcggggccgggggtgctcggctggggctggggctggggctgggcccggggccgggagcgctggggctggggctgggccgggactggggctggggtggctgaggctggggccgagggtgggcctgaaggtgttgggactgggggtgggactggggctgggcctgggggcgctgaggctgaagctggggccgggggtgggactgggggcgctggggctgggccgggggtgggactgaggctgcgggcgttcaactgggattgagtcgagggcagcggtggggctgggccgggggagcaggggtcgcgccgggcagcgtcgcgtgctggagcggaggcgggtgcggccggggcaggtcgcgggaggaggaagcgcctggggagcaggagctgggccgggcgggtccgcgccccgcacccgcgggggtgaatcggagtcgccgcagggggctcggggggccgcgtgcgaccgcgtgtgcgcgtcgtcgtgcgtgtgcccgcgagtgtctgcgcccgcggccccgccctggcggggcgtaggtgggggagggccccaggtgcggcgcgagctggagggtggagtgaggtgagcggcccagaaatcgcctcgcccactttcccctggggattgacagtggctcctccagtcgccggcgcccccgactcccgcgcggggcggggtcatgcaaatgagccccatgcaaattgcggcggggactccctgcgggtccgtggggctggaacgcccccaagaggccgttccgggaacgtccgggccctgacgtcactgcggcccggggcggggaatgggggtctgggcccatctgggactcctgacgcgtagtccggcgtccccacacccgcccccgtaggtcgcccctctccctggccgctgcccagccgggggatccgggggtaagggaggggcccgtccggtccggtgtgtgcaccatcccctagagtccatgccaggcccgaccaccctggaggccagaatctctcggcgaccgcacctcagcgcccccgcacacccctggccacccgcagcctttggaagggacccctgcgcacccattaccctgccctctcctctgtccctgcaatgaccgaccccattccccaagccccagctccaggaaagcaaggacccggcgccagggcgcttctgctccgccagtcccctccagcaccgcggaccaagccatctgccacactcggtctcacccactctgcagacgacagctgccggcagccaccagtgccaccgcgt

SEQ ID NO: 10931 - DNA, 5586 bp, Homo sapiens
cgggctcagccccgcacacggactcgccaggagtaggtggtcagcacgcgctgctggcggcgcaccacgcaggtgtaggtgccctcattgacggcgttggcgatgatgctcaggtgcgcctcgcccagggccaggtagccggggtaggagaactccaggggctcctggtccttgtaccagctgcaggggggcggggcgtctcctgcaggcacagccccccccgctgcctgccccgcacccctgccccaaggccgcccgcgggctgcccaccccgaggaccgcccggggcgctcactcactacactttccctttcttgtggaggatcttctggccgcagcggaaggtcacgttcctgccctcgggcaccagcctggttttggtcctggggggcggtggggtggtggccaccgtggggaaggggaattctgctccgggtgggggaaagagccccgtcagtgccccctcagccccgaccatggccaaggcccagctcccacgcagccctgtcccggccccgtgggcatcaccgtagcagaagtcgcagctgctggggcagagcctcttcatgagccgccggcgagcgtcgcagaagcccctccgcgcccaggacgcgcacacgaacagcctgtcgaggcatcctgtcgggagcgtggggagcacggcctggctcaggaccgcccggtccccgccctcccgcccgacaaagggactcaccgtagagccggtgcagcccccacagctcgtcctgggacaacgccttccagccgcgcagcgtggcgttcaggtgcatgagcgcccggccgtgttgtgagtgcatcaggcccagcgcgtggccgatctcgtgggccgccacgtgcaccaggtccgtgagccacacgcctgcgggccccgggggtcagcgcctgggagccccgggcccagccccgccgcccgtgggccagctccccgaggcccggtgtatctgctggagcgcagccgcggagccgccctcggccgcagccacggaaagataagaatgttctgggcccaggcggtgagctcggcccccaggaatgcagctccagctcccgctccagaggcgcagggggatgggaaagggagttcagggctgccgggatgggggctcccacgggctcccctccttgcctgctagactccagtggcagccaccaccccggaaggtccctcctgccgtctgccccaaagcccgaccgcggcagcccactgtgctgcagaggagaggcctccaggaggccagcctggacggtcacctttcttccagctgtagcgcgtggggcccaggacccagtactcgctgtcgtcgaagtggatgccgccgtgcggggggaagaaggcgtgggccagctcccccgtggggccgtcgaagcagtggtgcagcgcggagaccaggcagtccgtgtggttgatcgggtagaagcctggggggagcacggggctgagaggccgggcgcgcagggccgggccggggcgggggcgggcgcccacctatccggaggtcgctgggctgctcgggggccacctcgcggaagctgaagggggacacgtcgctccacatgcggaaggcggcagctagggcccgccgcgtctcccgcgggctcagcaggttccgcgggaaggagaggatcctgcagggagagtgagctcagcgggcgccggccgcgccccctcccccggggcccagccagggcgcacctgtaggtgaggttgaagtggtcccagcgcagcctggctggagtcagcgtgtagcggcgtctgcggggggccagtgggcccgggacccgggtgggggggaccgccgagaggcccagcgcagcgacgtctcccttcagggaagaaagcgtgcgtgggaggcatcggtgacggtccccaggaccaaaaactgccgcggaaaatggactggaaggaaacgggggtgggggtgcccagggctgggagcgggcgtggcgggtcctgtctgcctgtggtttcgggtctcctaacctgagcgccctgttgcacgtccctgggaacgcggcccagtggaggggaaggggctgaacagcagggcgaggcctcccacccctcccaacaactggacacaggggcgtccaaccctccgacctcgggacgcacatccggaccctcaaacaccccgcacaccccgcacacgtcctgcgggccccccgatagaccagacccacagacgtgaggacccccccaacccggcacctggcctcccccccgccgctcacctgcgctgcgctccaggccggcaccgccggggcccccagccgggccagcagcaccagcgcggggaggaggcacagggcgaccagcgcggctccaagccagcggcgctcgacgcctgcccccggggcctccgaggggacacgggccccgcggcccatggcagacttgctgtggggctcagggctgcatggggcagcaaggcgcgggggcccgggccgcagagcctccggggaggatccggaggggaggcagtggctcggcggctcgggttacagcccggtgtggtgggggggagggagacggggcgggagagggggcaaggctgcccctgaagggaaccagctggcccgtccgttggccgagctgcctgctgtctccagccgggggcatggggacccgcgtcccgtgggccaggggcagaggcctgggcatggcctgctgggcggggtcctcggaggggggagcgaagagggccccaggcagcccgggaagggcagcgccagggctcccgcttaggaaagggtagcagtgggggtccccaagcccccactgctgggcagtgagtgatctggtggcttttttcccaaatggaatcctcaaaaaacccctgagccccacatgagcggagtctccatcctggcccaggcagctgagctgggccgcaggagacgcgtcgctcgcctgacagtgtccccgagagctgggaggggatggccggatggggacgtggcagtgagtatggggcggtggagggggaggcggggagggggtgcgtgggtaggcaagggccgcggagggtgccaggttgcggggcggagggagggaacttgccagggtctcccggggagccgggaaggggcgggccctggctgcgggaagccccgtggagggtagcgcgtgaggtggagggtgtgtggctcctaaatccccggctaggccccagcaaaggggagagggagacgggagggacgggaaacggagctaagcgccgggcctggaggtctggaccggtcctgattgggggcgggggcggggagctcggagacccaaaggttcgacggggcggccggcgtccaggcgcgagcggctctgggctgggaccgagaccgggcaccggcgtcccgcggggcgggggtgggggattgggcagaggagcaggagattccgagccagaccggcctgtgtctgtctcgtccctccccgttttccgcgccggcgtcgggcccagggtgacggcagcccggccaacggggtcagcgccaagcagctggcggcggccgcgggcggttcttggaaagcgcgagaggctgggcctggccgccgtatttgctccgacaccgccccccgcccccccagctcgtcaccccgcctgcgtgcgcccggcccccagaccctgcctgggacgccccccaactaactccctgctgggacgggaccccacagccctggggagtgtcgggccccttggatcagagcgcgagtccccgcggccgcccccaggacggaagagcgaggggggcccgggggcagacacaggagtccccgccccgtcggacccgggcctggggggcgggaggcggccgtgcccgcgcctgaagggtgtcctggcccgaaggccgcagtccgggcgggagtctggacccgagagcctggggcgggcggggcggacccagggaagggccccccctcctcgcccccaggctcgcccgcgtgtcccgaggggaggaccccagaggcgcccggtcccccaggcagacagcagaggcaacgtccgagaatctttctttttataaaacacagggcgggggcacgcgaaggcagctcgggcgcggcggacggcgcggctcacacgaagatctggatgcggtcgcggatgggctggcggcagatggggcaggcgctgagcgcggagccgcagggggcgcatgcgccgtggccgcactggaacacgaggcggatgtggctgtcgatgcagatggggcaggtgatgcgttcctccatctgccggtagcggctctgcagctcctccaccagctggcgcggcgggccgggggcgggggcggcgctcgccacctcagagccgtctgcggggtgggggacgggtgtgagctgggaggccgggtgggggaatgcggggagcagggagctgcgggggggcgaggctgggggcggggtgtcacctgggacgggttgtgacctgcaaggggggctggcggggtgggtgatttggaggcagaggtggggcccgggtgcgggcaggaggtgagccgtggaaatcaggcataaggtggtgtgcgggctggagtcagggctgcaggtgggctgtgagctgggccggggtgtgatgggggggcggtgctctgggtgggctgtgatctggggtggggctatggagggagtgtgatctgggaggggccgtgaaatccagcggggctggggtgtgatgggggaggagggtgttaccttgaggcggggctgtgggccgggtgtgatctggagcaggcggggctgggggctgggggctggggggccgggtgtgagccttgggagggcggggtgtaacctggggaagggccatgggcggaagtgtgggagggaaggggtgggggacggggacccgcgggccaccagctgagcaggaggcgtgttgggggcgcagagcctcacccacctgggcgcagtttcttgctgacgaccacctggcacctgatgcacttcttcatcctgcgcgcgcactctgcgaagaggagagcgcggttggctgcggccctactagccgggcctccccaccccggggccccccactcaccctcacacacggtgcggtgctggcacggcgagaacagcaccagcagcgccagctcggagcacaccaggcactcagcggcctcgggccccggcgcggcgcccacgtgcaggttcgtcacggtgttgggggtcccgagcgtttgcctggggcccggggccgcgcccccgcccgcctgccgctccctgcagggggaggaggcggcttgagaggggcccggaggccgccggaccccatccccgccgtccacggactcaccggaagcgctgggcgcagccctgaagggccttgagcacgcgaccctcggcggccaggtccagcgggctccgaccgcggtggttggtgtagctcacgtcggcgccctccagcgccaggaagcaggcgaccgccgcgcccaccgtcagctccgcgctgccggggaggcccgaggcctgtagctgggcggcaggacagacgccggtgagggcgggcgccggggcaggcccgagggaggcgtctcctggcacctggcagccccagcagccggcgc

SEQ ID NO: 10932 - DNA, 1264 bp, Homo sapiens
cgcgggtgaatcgagcgtccctccgctcccctggtctgtagttagagacagtcccccgtcgcccgatcccgcacccgctgaggagcgcagggctgtgcccgcacctcgcctcgcacctgtctgcccagggaaaccgggagctccgcgggccccgccgcgggaaggaggcggcactgggtcccaaaaacccgtgttgaggagaagccgagcgccccaacacactcgccgccggccgggccgggcccccgcgcgccccgacgccgccccagccccgcccgcgcgcgcccgacacgctcgtccccgccctcgctccgacacagacacacgcgcgcgtcctcgcaccactccagaagctcatccggcccgcgcgcgcacccagacacgcgtggctcacacccgccgcacacgcccctcgcacaaacacgcgcgcccctcacgccctcggccactccagacacacggccccgggccccacgcaggctcgggcgtcgacacaccctcgcggcatggacacgcgtgtctcccacccactcctcggccaaacgcacccctccctgcagcccctcacccttgctcctcacactcactccccactctcgccccagaaacacgcccctcacaccgggcccgccggatccccacacttcccactcgcgccagaaacgcgcgcaccctcgtggcccctccctgccgcgcgtaaacacgcccggtccgcgcacgccctcccggcctggccccgcacactcgcgccagaaacacgcgtggccgcgcaccacgcccccggcccgcgagcacgcgtgtccccacgccccggccccgcccccgccccgcgcgcgcccccgccggccgccgccctcgaccgcacgcgccctccgcctagccccgcgccgccgcgcacctacccggacctgctgagctcggctcctgctcgtcaggcttgcgccgagccgccgctcactggctcccgcgccccgcccggccccgcccggcccggcccagcccggccccgcgcccgctcagctccactcgccgcagctggaacgactcgcggggctccgggtaccgcggtctccccgccactgcccgagtgcgccgcccggaccaatggcggggcgcggcggtgagctcaccggaccagaccccgccccccaggccgcgtggtccaatcggaggatgcgacgtcacccggagccgggcagaggctggtgcggggcgcggagccgctcggcgcggggactgcgccggaactgcgcccgagccgcgc

SEQ ID NO: 10933 - DNA, 716 bp, Homo sapiens
cgacgggcgcgtgaggcccagagaggagcagccccgggacccgtccctccccttgcctgaccctggctaggaaaaggggcctggagcgcccccgggctccggaaacgcgggaccctccgcaggcagccgagcagggcggccgccggggtcaccgctgggcgccgccggagctttaattcgatccatgtgcgggactccggccttttgtgcgggagcttccgccctgcgcgccgggtccccggctcccgctcccgggctgggactcggccctccgccggcctcactgagccctcgccccggacctgccgactccccgactccggggagagagaccaagagactgggacgcaaagggcgtgaggaccgcaccccccacccgcaggcccctccaggggcgccgcgccgggggtcccggctggcgaccgagcaggctccggccgagcactgccggcgctgtcacctgtgtgcaccggggacagggacggagggacgcgacccccacccacccggcccgcttacctgggccgcccgcgccccggcggctccgatccgacgcccgagccagcggagcccggagccgctgggcctcccgtcccctccgcccgtccgccctccccgccccctcggctccctccgccccgccgccccgcgccgctttaccataaaaggtgaggctcggggggagggggcgcgggattcccgccccgcggaagcgg

SEQ ID NO: 10934 - DNA, 619 bp, Homo sapiens
cggtggaccgcctgggcgggcaaacgctctctcacgctggcgggcaggatttgaacccgggttcctagggctctgcaggccgccactgtccccgtcctctctctgtctccggcttctcccgcctggcctgccgcggcccgccgccccctccttcctcccctcttccgcccgccccctgccccctgcctcctccctccgccttctcccaccccctgcccctcgcgacttccccctcccccccgatcctccggcgccgccccctcctcctccttgtcctcgcagcccaaatacgcgacacctggagcaatagcagccgcccggcggcctgggcctcattacaggccggcccttatcgcggcgtgcatcacattatttcatttcaaagaatccgcagagaaacccgtcccggccgacaacagaaagtaaaaacacagctgactcccattagggccctctcacaggctccgcgtgaggtaatgaaatatggaagcggtgagatatgtaatgctttattaagcggtctcagctacaacggcgtgcatgccaattacgcctgcaggctaccgcccgcccccggctgccggaccacccagcgcgcctccccccgagtcccggacgg

SEQ ID NO: 10935 - DNA, 293 bp, Homo sapiens
cgctttacggggcaaactccgaggcccagccccgcgtgggagccgcagcggggcgggcccgctctgggctgggcgggtttctctagcgcagcgctgggggttgcgggcctctcagcagccggagcagcatcctgagctccggttgttggagcgctgggacctctggctgccgcccccgcagcagcagcaaccactactccgctgtcggcggcgtctccttgggaagcagcagcaactggtggagctggagccgcagcagcctgagtcgccgcagcagcccctgccggagccgc

SEQ ID NO: 10936 - DNA, 2748 bp, Homo sapiens
cgaaccggtctcctccggcttcgcattctccagggccgcccggcgagctcttgcatgttccccacccgccaagcccgtcactcggccccgccctttcacacgcgcattggcacgccccttcccagcccccagcgggcgggcagcctgccgggtacccaggaagctcgggtccctcggcgccggaggacccacaacccagccaccgcaacaagtccgcgcagccaaagcagctcgcctgggcaccaggccccaccgtccttgttccgtggccccaagagggcccgtgccagttcccgaggcatggccgcctggcgtccggcacatcccagatctattcctctctgagggcaggggctctccggggagagaaagagcagttccggggcccgcttcgggtttttttgcatagactcttcaggcacggagaacaatggaacagctctgcgcgcttcctccactcgagcaagctttgttcctcccttcccgcctgctcggcttccattagccacagggcaaaggcttcccggtcaaacaggagtctcggcgctaacgcccagagctttcgacacgccctaaaagacctgcgggtgtaggggttggggccagagccggggctgaggtatcggacatgcgcccagatgcgcacagctggcagcccgcccgcccccggccctagacgcttcttttagccagaatcctcacaccgcggggaaatccgacttgcgctcccactcgggatccacagaggaagtggagcctcagctgtgttccggggccaatcagccctcacatctgctctcccacatctgtcctctagatccgggctctcgctggacgctccccttgcaatgcgggatgctcctgtcaagcgcaggccacaccacaacggaggtttccaccagtcccaggttttgccatattgggattctggctctatttctgagagcctgtaaccccctcaccccccatcccattgtccagcctcacctcgggcaggccagagtcgagcccgggttcccgcctgtaatgtctttaagaaggtacacttgagccatgcgcatctggaggtgggccagctcagcacatctgggcgcaatgcccatcacagcctgatcgtgaacaggagggccctccgggaaggcgcaaggggagggggcttcgctttccccacaccttccccagcagctggttaggagaaagccaggggcggggcggggcggggcggcaggacttacccagcatctggctgaagagcagctgctccaggtctcccagcacggtcaccaccagctcggggtccaccttgaggaaggcgcgctcctcctggcccttggcagaggggacaggcccagagctcttttgcgccttggccttgctggagagcagctcgtcgtccgatttgccatcttcgctcacggccgcttcaggcgccttgctgagcggcttgacctccgcatagggtcctcgagggatccggctcggctttcccaggttgggcgcgagcggagccaggggggtcttggcgccgcccgccgggctgcccttggcctggaagagcgagtgctccgacttggacagcgtcttggacatcagcggagcttcacggcccttggaccccaccttgcctaagcctttgggcgccttggccatatcgtcgctccattcgggctcataaagctgcagctttttctcggagtccgtgagaaaagagaggttggtgagtgacttctgcttgcgcaggttggaggcgggcggcccgccggggacacggctgtccacgctgccggacttgaagaccttcagctcagccgcgctggccttggccatgccgccgccgccgccgggcgccttggcgcgcttgggcagcatgcctctgccgtccgccgctgccgccttcctgccggcgccccgcggttcgtccgcgccctcgtcgccgccgccgctgctcagctccacctcgggctgcacgctcttgacgctgctgcccagcattctgcccgcgaggagcgcatggacgatccgcgcgtctgcaggcacggggggagggggcagggggcgggagcgcaggaggaggaggcgggggaggaggagggggagagagaggacggaagaaaccgaggaagaaggggagagaagggggagagagcgagggaggagggagagaggcaagccgagggcgcaggggaaagaaacgcgaggaaggaagccgggaaaaaggaaagagcagggaagccggggagcgatagggcggggtcggaggaaaaggggcggggcggcggggaaaatacaaattaaaatttaaaaatcagtcaaaggaaggatggaagccccgcggctcctccggcgcccagcggtgcttttgctttggtgtccggatcccagcccgcggcctgcctgcctgtcagtcccgtggacaccgcactgccgggcagcgccccggccgcactcagccagccagccagcccgagtcgaggctgcaggctgcagctccgagcagaggaaggagggaaggggaaggcggggagcaaacaggaggaggggagcgagtgtgcgcacggggagggaggtgggggagagatagtgtgtctatttctggctcgggagggggaggtatctgcgagcggagctccaggggcggatgagtggggggtagggggaaataaaggaaaagcagtttttctcccagctttccgcgtagaagcggggcgggttcttggattctcggagggcacggggaccccctgccgt

SEQ ID NO: 10937 - DNA, 433 bp, Homo sapiens
cgggactgggcgctagccagcagcccgcaggaccaggcggggacaggcgggcagtactcacaggtaagccgtcagggggtccaggtcccccggaacggcggacagcccgagctcagagcagtcggcagacagcatgatgccgtcctcctggcagtggcagggggccgggcaggcggtgggccccgggccgggctggggggcgccgccggccctccgggaagcgcacagcgcggcgcaaagccatagcgcccggagccccggcgggctgggcatctcggcggtcgggctactggggcacctggcggccgggcgcggacgcacggcgcgatggccgcagctgcttcctcccggtcccggcgggctgcaccgtcggtggggaccgccccaggggctctattgggcggcggcggcggcggtgggagcgccgggacgg

SEQ ID NO: 10938 - DNA, 1376 bp, Homo sapiens
cgcgggatccccactcctgcgaggcctccagagcccttctgggaggaggcctccgctggaacgtgtctgggtgaggagagggagatcggctcccaggcagggacggccagggtgcgcgcaccccagcttctgggccatcccggcgggagtctgcgctccttttaggcgcgacccccaggaaggtctcgggtggtgaccgcagattggagagtgagctgggctggggaaagagtgaggcggatcgcccccaacctccggcaaagtgtgcgcccccgccccaccatccaggggcggcggctcttgatgagctcatgggggcggggcgccaggagtcccgcccgcgagcccccccctcgtccccgcgaagcagcagtccggaatccgcggccagggacccgcgcaggcccctccttagctgaggggcggccgggtactcgggtcccgacccgcgaccaccgcacccatcaccaccacagcgggaactgcccggcggcccccagaagccccggcccggccgcagaggtgggcccccgagcacagaggccccgaaactcggctcgcagccctcagccccaatgtcggggggcgcggtggccccgggcgaccccccaccccgctcctggagcccacaggtggccccacaacttcgcggcccgcgctgcgcccgcggggcctagcacgctgccgcgggacctgcccaacgtggagtgtgtgcctgccccctcccgccccggcccccggcgcagcccttacccagaagacgaaattgaagacgaagagcaggtacttgatgcacttggtgcagccctccactcccatggcggcgcgggcggcgggcggcctgcggggcgcgggccggtcctgggcggcgggcgggccggcgcggggcctggcgggtggccggcaagggggcctggcgggccgaggggcgggggcgcgaagaaaggggcgcgggggcgcgggggcgcgggggcgcgtggggcgctgggcgccggaggcctggcaggatgcgcggtggggtcgccgccgtcgccgccgttgcgcgctcgctctctggccgggcgcgcgcctcgctccgcagtacttatagggcgccgcggtcccgcccctccataggccccgccccggccagctcacgccccgcccccggccccgcctcctgccgccagggcgcgcagccgaggggtatggggtcgctgcacctacccccaacttggcgcgtttcggccaggacctcagggcccaggtgcaccgtgctgggcgcgggaggcgtccccaagctgctgtcgcgctccgagcccccaagggggtggcagcagggccgcgcctgaggacaggcatgcagcgtctgcccaggagtgcagccccggtgccgg

SEQ ID NO: 10939 - DNA, 3393 bp, Homo sapiens
cgcagcggaggcgggaggagagtctctggcgggcatttgtcccccgcgcccctcgcgcgcccaaggctgggctccggggcatctcacccgggccgtcccgggtccagccccagtttagaatgactccacaccccccacatctccaagtctcagaaaccatcgttctgagaaccccaaggaggacaccctttcccgggtcttctgcagcgccgagccccggcaggcctccccggcgctcgcctgctgcgagaccttcctgccgccccgaggagcacgagaccccagccgcctgcagatcacccacatttgcggagggtggcagcaggggcttggctggtttgaaacgcgccggggaggcgcgcgctgcaccaaaccccgtccctgtccccaagggcagactcggggtaaggggaccaagacctccgacgcactcagcgccatggggacagccatggccaacactctgtctctgcggtcaatcccaaggttaccaaaactctccatccgcagagagcgcgcacagcagtgcggacactcggggactgccttaaggaaggctgagccctgggagcgcgtggactccgccctaccgcccggcgattggctcgcggggctgggggcggagaccgagtccgcgctgtataaatattcatgagccggcagcgcggcgcgagcggggctggagccgggaagttgggctaagggcgctgctcccgccgaggaggaggcggcggctgggcgcgggccgcgccactcaggtgtccgctccgccttccggtctggatttgctcctgggtgtccagcaggaaggagactgtgtgcacctcgcccgactgcggccggagcgcggcgctgacttttccaggcggcgggggtccgtctgtcccggcggcggacggacgaaggacggacgccggagaaagagggcggcggcctgggccgaggcgggtccccaactccggcggcggcggcggcggcttggccttgggggcgggcatgagcccccgggggccgagtggtggccgccagggctgacccggcgcggcaagcggcccggcccagccatcttgactgcgcaccgcggccccagaggaaacttgcggcgcctccgccctctctgtccggcggagtcaccgccgcccggcgcggcggggagaagtggtcgggcgcgcggagaggaggcgagcgagcgcgggacgatgagccgaggcccggccgctctgcgccgcgagggctgagcgcgacccggggccagcagagcggacctacggactgtggcgcgcgcctgcagccgccttcaaacccccggagcggcggaaaggagtgcggaagggccctgcccaggctgcgggccgcgccgctgcggacgcgcccctagaaggggttagattatcggcagacccccctcccgggcgaagcataagggagaccccagatcacccgctgtacccgtctgcggctctctcgtgggccccccccccggcacccctctgcgcgccgcctggagggcgagggcaccgggccgaggcgcacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggcggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctcttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgc

SEQ ID NO: 10940 - DNA, 1381 bp, Homo sapiens
cgtctcaacgtgctgctctggtaccaggacgcgtatggggaggtggagataaacggtgcgtggggcccgcgtgggcgcgaggaggggtcgccacggcctccctgagagtgcgctgctgagctcggctttggaggcgtgcggcggggaggggttagcccccgggtgctctgtgcggcccggctggggttaaagtccggggcgggtctgcccctgtgcacgtgggagatggttaggggtgttggggaccccgagggctggtgtgaggcctcgggagccatcggggtgactggccgccgtccgcagacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctggtatcccgggccccaccccgtgccccgcccacccggagggcccgccccgccccgccccatgctccgtcccacccggggccccacccccaccatcgagctccgcccccatccccgcccacccgaggccccgcctcaaaaacccgcccaccccgcaggccccgcccctcccttagagctctgcgtccggcaccgcccctgagcctccggccccgccctcccccgcccccgcccctgcgccgccgacgcccgccctcccgcagagccctccgccgacctcttggtgaacctgagccgctgccgacgcctcatcgtggtgctttcggacgccttcctgagccgggcctggtgcagccacagcttccggtgggtcccgcgcggggttgggtgggccccagcgtagcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcgggagggtccggggctagcggcgggttagagatgggcggtgcccgggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaacccgtgggcagccgcaggtgtgctcttgggggccaggacgccaggggcttccgaggtgttcacacctgcaaaccgccccgacctggcccccagactccttcctccgatttttggaaagaagtgcagctggcgctgccgcgg

SEQ ID NO: 10941 - DNA, 493 bp, Homo sapiens
cgagctgcccttgggcgcgcctggggctgcacctgggtcacgtgggcgccgttgtgcagccggcacctcccggccaaccccgcggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggtgagtggtccctggagtcactggctcagggcgggcccgcgggatggggcgggcggcccggggcgcagccggccaggccgttgctatggcaacgcggtggaaaaacgggcctctgggtatctcgctgccggccggctggtaaccccccagcggagggaccgggccgagcccgcggacccctccgagtgtctcctggggcccagccgttggtaccccatttcccccgggtccgg

SEQ ID NO: 10942 - DNA, 922 bp, Homo sapiens
cgtgcccccctccgtcacttggtacggcccgtgcccccgccgctgatctggcaggctgcgcgcgcacactccggccgggtgcgggccggcggggcacagcggcctctacggcccgcctccgtcagtcattccccggtccctcctcccgctgctcgcgtgctccgggccggcccagcaccctccgagttacgtgcccgcgctccccggcggggaggagcgcagccgcgggggcgcgccccggtgactccgcccctcagctcccctcccctgagcccgggagcccggctcgcgcggctaggtgcgaggagacccgggaccccacgcccgcccgccctgcccagcgccccagccccggcgtgcgaggcgccgctccctcctctgccctgcgcggtgcatggaggggcccgttcggatcgcagccgccgccaccgtagccgccgccgcgcgcgcgcggggggatgacctgggggtggctttccgagccggctgcagcgcaggaggtctggaggcttagccagccccgcggagaggtgcgggggtgggggtcccgccgcagggtcggagggaggggtggcgcgcgggcactgggcttggggggccttggcttaggggacgggaggtcccggggacgggcgggccggcgttccctggagggcgtgggggtgcagggctgcgtgcggggtctggatgctgatgcttgcccggcggggagccccggcgttccgcgtcctcgggggctcggaggcacctcgcgggaggaggcggggtgaggtgtcagtgacacgacgaaacctcttcttgacgatggtcctcgggggcaggtgagatgccgcagagcggggagctagggcgcccgcgcgttttcccaagggagccgggtccctggcctctctcaatctccatccctgcagagcgcccgcga

SEQ ID NO: 10943 - DNA, 719 bp, Homo sapiens
cgctcgaggatgctggaggtgggggccgccgcttcagtccgggcgcagggctgggggattgggggcggaaactttccgcagaactgtcccgcttgctcactccaagggaacggagaggatccggcttcccgcgaaaatctggtccagggaaagggaccccggaaagcagctccgcagggctgtggcagccccaccccgacccgcgctgcgcccacgtgcagggcccgaccccctccgggaggcgcggcgccggctggggtcaggcggccgaggaccccgcggctccccgccccgccccgccccgcgggcccccgcgcaccgccgccgcgtactcaccctcacgggtggagcggggcggggcagcacggttccgcgcgcagctccgatccgctaggcgcaccgaccggcggcgcagcgctggcgcgacggctcgactcggccgggtccctgtcccgggcgcgggtccggcctgggagcgggcgagtccgcctgcaggggaggcggggacccgggcccgggttgggggcggggaaggggctggacacgcttgcgcacacggcggcccgactcccaggagctcccgggaggggtagaaagggcggggtggaggagggggaagggcgggggtgatgccgcgcggtcgcaggcttgggatggtgttcgcgcctccgagacccggacagaggcaagcaggggcgccgtgggtgccagagaggcgg

SEQ ID NO: 10944 - DNA, 958 bp, Homo sapiens
cggtgcacggggtcacacagtcggaaacccttgccggccccgggttactccctttctgaaacggtcttcctcggagccatcccctggaggaccccacttcgctcggtgcccgggccccgcacccaccctccccttcccggcccgcttcccgcacggcgcctactctgttcctcgtcctctcgtcccaccgccgccctgcccacactgcctcccgtgggcgcccccggccgctcccccttctcgggtctcggcctgggggtgcccagcccgcccggcgccggctcaaggccgcgcgactccgcacgctctcgagacccgcctcgccgcccgccgcccgggccgcactcaccgcgcccgcaggacctgggggtctccgctctgctcgcgctccggcaccgccgccgccgccgccgccagcggaaacagggggcggggcctgcccgggaatggcgagcctgcggggcggggcggcccgggggcggagcggggaggggcggggcggagcggggaggggcggggcggagaaggatcgcagggctgagcggggcgccagcgccagtgcccggcactgccccgggctgggtcccctgcgttagaggaaggggagcccggggacggggcacggggcccgcgaggcacgggtgctctctcggggttccggaagcctccctccccgccccgccgcccgcatgcccggaccggccgctcctccgaggtgctatgatcccgccttccccctgcggcgaacgggcctcttcccggggtaggggcggggaggtccgggcctggcagtgcgctctcctgggctctgcgcccacacggcacccaagggccttcctggcccaggcctcggctctctccctcgcgccaggctgcctggcctcgccaccccacccccacacctacgaaccccttccctggtgtttcgggcggactgtgcgagatgctgacagcgcgg

SEQ ID NO: 10945 - DNA, 3843 bp, Homo sapiens
cgcgcgtggcccccggagaggcgcccatcacctgcgtggcgcccccccgcgccggagtgcggccctgctcccagcgccagtgcgccgcgcggctcgccggcctcgtaggattggctaccgcctcccattcatgtaacctgcgtgtgcgtgtgcgtgtgtgtgtgtgtctctctctcgctcgccctctctttctgtgtgtaagagagcgagggtgggggacggaggcaggcaggcgagcaggcagggaggggaagaagagaagggaagctattaaacacacacacacacacacacactcacacacgcgcgcgcacacacccgccccaaccccccagaagcctcgggattgcagctgtttcatgtggggcagcagtgctggcagggacgccggccgggagcggccgggagcgggagccggtcgtgcgcgcgcggctggaggctcgctggggctccgctccccgcgggagctattgttggtctcgctggagctgagcgcagagcccggacctgctccttcctgggcgccccgctacggctcgcggagcagaggagccgcgccgccgagagagagaggagccaccggcgcggcgccttgcctccctgccgccgtcctcgccgcttccccggcggtagcagcctgcagccacggtaaggcggcgtgatccgctctacggaaaagcgccttggggaccgcggcgacgcctcgccagctccatcgccctctgcactgctggcccgggcagggttcgggtagctcacgcggctgccgagggctccgggagatgtttgcttgctcccctggcccaggaggagggaggctagggcgcgggtggccgaagaggcaagctgttctggagcctggagccgccgcagcccccggagcccgccgcggactggagcctgggagcaagggttgggggagggcagggaggtgggaagcgggtgggagggaggcggcgcgccccaggttcgtctgcctctcccggatcccgttccccgccccggcccggtcgcctgcagcccctctgcagactagctcgccccaggcccccgtcgggcgctggaggagcccgcgaggcggcgccgggcttcagcggctgcagcctgccctgcggggcaagtgccggctgcagcagccccgcacgggcggtggttggagctcagatcctggagatgcgaccccagctcctcgccctctgcaacccgcggggcgcccgcctctcctcaccgggcgcccggccgcggtattgatgttcgtctaggagccaactgaggctgcagccgccagatggacgcttggagggctcccgggtgtgagtgtgactgtatgactactctcacccccagcttcgggaaatgtgctctgggttgaaatgtgatcaccgagctcctcagtcattttaattgccatttttaaatgcggtcgttacattggaggagcagactggaaggtagtggggcggcgtgtgtgtgtgtgtgtgtgtgtgtgtgtggacacacacacgcaaccgaggaatacacaaccaactacttgggtgaagggcggggggttcacctagtgagtccttcttggcgggggggtcgggcgagttagctgcccgctgcccgccccttctctgcctgcccccgcctaggcgaggttggaaagtactggaaattcagctgcgtggtccttaactttggaaattggctccgctttcagggcaaaatgttaaggcgatttatgcacccgcgtccatgtggatgagtgtattactgctcagttgggtgcagagccctcaacagtaccgcgccaagcccccacccgatctctaactccctcccaccccctaaccgtggagagagggtttatagaaatgcagttatctgtaaaccatcgacgcagtgaaaggggcgcagggaggcagccagagttttgcctgaacctgcatactggcttggtgtttgtagcacacgagatcaccccgctgctttgtagaaggcggtggtggggcaagctcgggattccaatcgccggggtggggggtggggggaagagggtgcccatgtactgagctctgaggccgagtaaggagagagatctgctgagcggcatcgcgggcaattacataagctgcctcggtgattacccggaactgtgatgcgagctcccggttctcgaaagacaagcctgaaagtttgcctgcttggggagtgtaagtaccggggcgcccccaccccggcctgggtagctaggatacgcctcgcaccacggcgcccacttgtgcgatgggcgtcgggtgctgatgctgctgtccccaaagaaccggttaccgaggcagggactaagtgggggcatccggaattgatcgcagaggaggagtcagtcagaactgaggtttcattgggtcttcagagctccaagtcttccctcggaggtgttggaaggccttccagggaacgccgttttcagaaactgacttggtgtcctggggagccccaaagcccctcttttccgcccttcctgggcgcccctccttgtctttcaagccctgtgcccttcacgtgtttagaaacctgcccgcggtgcctggtcccccttggagatgcccaggcagcccagccatccaggcccacgctggcgaggggttagagggagtagaacgctggctctgccgggctgccacccttacctacacctattcctggtttcctgcgctagcccggcgctgatggggacgggatggggctggggtcgggtatggcttccgttccttcgcctctcgcctctgcagacagcagtttgcttctgttgcgtttattctccccgtttcgccgcttccctccagcgccgcagcctgtgtatcacgttgatgggctttgatagagaaaccacagtaagagtatgcttttaaatcttgattttcgtctgtagggggataagccaccccagccctgacacagccgtggggaacgctgaagtctgggacacattggccctgaactcccttccccccagcccgcagtcaggagatggtgatgtgcatgggtggggagtgttttgtttttgccacattccagcgtcctgaaacctctcgtcccctcccactgaaatccccgatctgtctgaatctgttccttgctgtaaaataaatcctccctcccgcagacctgtggggcccttcggatttcctgccgctgccatgatccttaacaatgcgattgaaaagccagtgctcggctggaaaaaaatccccaggtgccagccggccgcgccttgaccttgctgaaggagcctttaacccggctgccagaggggctctggtccagccgtgggaatccaggaagaaggagggcgccccggaggcggctgggttagctccccgggcagggcgggaatcaggtcgcggcggggaccgcagagggggaggggacgggactccgcggcaacctgtttcccggcgagccgggcccgcgcatcccagctccctcgccccagcccctcgtggcccgcctcccccgccggcctccagttgtcttcgtggtacaggagtcggccgcgactccctcgcgctctccgccggagtccgcgggacgccgccaactttgggctcctcggtggccggagcagcggtgcgaaccagcggggcggccgggtgggcggggcctgggcgggaaactggagccgagaagaccgcgttccaggccaagttccagccgcaagcgccgcgcggcacagtgcagggtcccggccgcgcctttctcccgtccccggcccggccgcgttcctgcggactcacagcgcgctccgggcgctctgcagttgggctttcagcgggggagcccttctcgtcaaagttacga

SEQ ID NO: 10946 - DNA, 384 bp, Homo sapiens
cggttggccgggggacgtgtccgcgctgctccccctccggccgccagggggcgcaggaagaagctttggaggtctgtcccgggaccgcgtactcgtccttctttcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccgg

SEQ ID NO: 10947 - DNA, 1432 bp, Homo sapiens
cggacgccagggggtgcccccagctccagcgcagaaccccgccccgcacaactcaccggatcagccaggccgtcgaagggcaccaggtctcagctaccacgacgctccgctcgacgggtcgcagccatgcaggagtggcagaggctgcctgacgaagccctccttgggggtcgatgcctctctccgggtgggaaggggcgctgtcggtgagggctatcctggcgccggcctgcgccgtccgaagtcgggggggaggggaggtctccgttcagcaggggtcacgcccgccccggacgggggccgcgcgggcgctcaggcgacgcatcttcgccggggcccgtgatcgccacgtccggcgggcggcgctgcgcctcccctcggggccccgctcaaggctgcagctcggcccgcgccgctcccagggcgccctctccgcccgcgctgggagcccggcggccgcggcccctttcgccagccccagctgcagcctgtctttgttgcttcctctcgctcgcccgcccgcccgcggcttgcagcccccgggttcgccccgaggtggagggattgtctccttcgggggttgcacgcacccgcagcggccccggctcctcgccggacatacaccggcccctgcaggttgcaaagaacagcggcgagaatgcaccggcccctcctcctcctgctctgagccccgggtgtggggggaggggaagccggcgaacagcggcggcggcagcggcggcggcggcggcagcgggcgacgcaagctcggatgcagcctcgggggcctcggcgctgagaaacagccgatcccagtggcgcaggacggacacgaggacggcccgggggactgtgcaccgggtgtgcgagctcgcaagccgcagcaggggccgcgcgcgctgggctctcacgcgcccatggccccgggcggcgcgcgggggctcccggggccgcagcctcgcgccgtctggcgcgcgccggcgcctcgcctggtctcaggcccgggtgccgcgcgccgcgccccacaggcgccgggcccggctgtccgcctcccccggccggcgcgcgcagcctctccgcggagcagccggccaggcagtcctgcccgctgctccgctctggcccgactgacaggcgcgagcgccggcagcagcccccgcgtctcgtcccccgcccgccccccgcggcccagcccaatcagcggcggctgagaggcggttaccagggtgacgcggcaccgcgtcctgcgaggggcggagccgggggccgccacgcgcgcttttcgcggcaaaattcaaaggccggcagggcggctctccaacctcctcccccaagcagggacgaggcggaacttgcctcgcgaggactgcaactcccggcatgctgcgcgccggcgccgggtggaggggccccgactgggggcgcagggcgt

SEQ ID NO: 10948 - DNA, 325 bp, Homo sapiens
cgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcgggaaggccgccagctccccaggccccgcgctctttgtctggcgtgggggtggggagccgcgcctggccccaggagcttcctggcctctgccaacccctcgctcctgcacactgcgctcattgtctgagatgcgccgagacggccttcgctgacgt

SEQ ID NO: 10949 - DNA, 1242 bp, Homo sapiens
cgctcacagacaacgctctcccgccgctggcgctggtccgggatgcggccccgagacccctgcagccgcgcgctggctcaggggacctccgcaggacgcgggcgggcgccggggccgggtcgggcttgggcagagtgacaggctcccagtcgtgagcctcacaagcagatctatttacaatatcccggataggagtccaggtcgcgtcgctcgcgtcgcccgcggggacccggcgtgaattcacacgctcccctcccaccgcctcgccgcctgtcacggccccgagacccggtcagccccttcgggggttcccttcgccgcgcagtactccgcccgtgagcagcccccgcctgcgctcctccctccctagggcggccgcctccactcccggctcccacccagcggggatccaccagggcgagggctgaagacctcgcgggacgccgcgcgccggggacagcgacgcacctaccttcccagccacctgggaggctgcaggtccgggccggagcccgaggctcaggggcgcgcggagcagtcctggttaaggcgcagggcgcggggttgcatgggggtccagtccagcgtgcacaccgtgcacctcccagcgcagggctccgcgctctcccgtagcccggcaacggccgccaccccagagccccgcccactaggagccccgctcagggcaccgcccacccgggccccgccctcaccgcggctctcgccgtggctccgcccccgtccagagccccgcccccagcgcacactgcgtcagccggacttgctctgcagctgggttctttggaggcccccactccgcggctactgaagcggatgagtgtgaggctgactgggggcttggggatgggggaccggagaccaccaagaacatggctgtgttgggaaactttccttcagagcagagagggagggttcctttccgccggggtgttccccacctttcagcctttcccgcgtgggcccgcatcccagccagaggggatacggcggccaggtctgcgctgctgcgcctgagctcaggtcggcagaggtcgcagacctcggctcctcagccggcagggactcgcaggtgcgcgttcccacggacgcctcccggggaagcccgagttcgcctcctgcaggccgggaagcactcgccccgagacggccgcaccctcgcagcggaagggcgtctgcaccacagctgtagcaccagcgcgtgcgaggcggggccagggccgg

SEQ ID NO: 10950 - DNA, 1460 bp, Homo sapiens
cgcgtctctgctccctcccgacctagtcgtaaattccgagcctcagcggccgccctctctctcctccgctcttcttgacccaaggtctcaaaagacaaacgtgtcacttcccgccccgcccctggatcctggtcccgaccgaatgtagtggggaccgagaagcgcaaggtccaggacttgttagaggggcgcgccaagggcgcccctgttccgccaggacatcaccgcctgggtactctacttcaccctcccgcagccttctttggggccgggcggggcggggcggggcaggggggccgggcgcggcctacgcgccccctcgagtgcgcggtgcgggacgggcgcggttgacgcgctcccgccggtgtctgtgcttctccgcaggccaggagggcatcctgcgctgccacccggacctggcgggcagcgagctgcagcggggcacgctcacggccgagtcgcagcgggaacagagcggcgcaggcctgaggagcctgggcgcggacgagcggctgcggctggccgagctcaacgcgcagtaccgcgcgcgcttcggtttccccttcgtgctcgccgcgcgcttcagcgaccggacggcggtgccgcgcgagctggcgcgccggctgctctgcccgtccgcgcaggagctgcgcactgctctgggcgaggtgaagaagatcggcagcctgcgcctggccgacctcctccgcgcagaccccgccaagctgtagctgccgcgcgggccagggacccgggacgcacaaccggacgcgcgggggccacggcccggagctgtgcgtcctgggcgggaggcggactcgggcctggaacagcgtccacacacgtgcacaaaggaagtggagaattgaggcaatcatacgagtaatgagtccttttgtccgcccacccacacgcgcacgcgttgccaaaatatccatattgtttagtgctttgccccggatttatccagctcactgcttcaattcttcactccctttgcggcccccgacaccaccggcctttgtggattccaaagcgtttatccagttctccccaaccctctcctgctaagcccgaactgcaaagcaaaacggacggaaaaggaatcttttatgccacagcggtttgtctgtttttctcttttcccacttcatttgctgcgcccgacctttacatgtgagcggaagcggtgttctcgctcttgggcactaggggagcagactgggagccaggaaagtcaaacgctggcctcggtccggcctggggagccggggaagccgcaggaaggaggcggtgggccgggaagagccctgcgaagggaagagccaaccgaagggttgggaaggcgccccgtggggacggacggaatagttgcagccatcgctcctaaaaggcgggaggcgtccagctaaagatctctcccggaggtcggctttgggggggtggctcgactgccccgg

SEQ ID NO: 10951 - DNA, 1064 bp, Homo sapiens
cgactggcggctgtgtggcgatagcgcacgcctagttcctggaaagctttgcagtccatcaggagagtctccggggcgcctccctctctggctcctccagggacctgcgggtagtggaggagttctccatagcgaggcagcgcgcccaagccggacaggatgcccacgcggcactcctctgtctcgggctggaaggcgaactccaggctccgcgcgtccagggcattgctggtccccagcagctcttccacgaccagaggcaagttccgagtcacaacctccagctgggtgaagaccacctccacctccagtaccagtggtagcactactgcccctccgggcgcgtcatagcgcagctgcagccggacgcggtcccgagacgggctgcgcgcgcccaggtgagagtagcgcacctcgccagggccaaagtcgcacgggaagcgcttgggactcaggcggcccggtcgctgggccagtgcgtcgttgtctagtaccgaaaccgcgcagcggtccccgggctgcacctgcaacaccaggtcatgcaggggatccagccagacttcacggccgaaaggcacccggagtccgcggttcgccagcactatggcctcctcagcagggacccctgcagcccccgcgagaccaggggacagcaacgccctgccgaaggcagcgggctgtgccgggacgcggcttaccagtgacaggagaagcagcagcagcagcagcagccggggcggcggtggcggtcctggttgaaagctggtggagttgcctgtccggcgcgaggataacccgggagtcccggctgagtgcatggtcccggtgttcgggcttggacaggtcagcctgagagcatgcgaagtcggtccccgggcagacaacaagagacaccgccgggaagtgccaggaactccgcgcgttgcccgcggggtcctcctgtagccggggctgggccagaaggatggcaaagttgcgcggcgccgtccgggctggagccgcagccgaggagccgaagccttcccaggccgtccagctccgccgctagcgcctcaatcgcgcgg

SEQ ID NO: 10952 - DNA, 622 bp, Homo sapiens
cggcctgccacgcgctcccgtcggggcccacccgcacctgggccggggctggtgtccacgcgcgacggctcgggagcacggacctctgctccccgcagcaccgccccccgggtggagccggcggccccgcctcgcagagctggggctgtacctggggcaacggggccgggcctggacgtcaggtcggaggagtagcacctgccaggagcacgtcccgccggcaggtcgcaggagccctgggagccgccgccatgggtacgctcggcgggtggggggccggccgggctaaagactcggagctacgcggggcgggggccggcaccgagggccgggaggcgcgaagggtacgcggcggcgggaagcggggcgacccgaaggcccacgggggccgggaggttgcggggcgcccgggatcccctcccgggtggtcaccgtgcggccggggcgcggaagccagaggtgcccagaggcgccgactccgccgaggttgcgatcctggcccgcccgcccgtggggcactgtaatcctcgtattcccaccctgcgggccgggagtgcgcttggagcgggacgggacccagcgggtgacggcaggggcggcagaaacaccgtctaactggcgg

SEQ ID NO: 10953 - DNA, 1622 bp, Homo sapiens
cggccccaccgggctgcaagggccgggaagctgtgccgggggcgctttagaggccagagccagggagggggcccgcgacacaggcgggtcttccaggcgggcccagggccaggacagcgcggcatcacccggccagtcctctgcagccaggatgaaggccggggacagacgttcagtcctagaccctccagacagggctgggcagtgccggtgggtgcctgggagaggcggaggcgggcgcacttccagcaccaggttcgggaaggacacggtgcccagccgctggagcccctggcctgcgtgccccaccctgattttctggcatctggtgaacggcccctccgcagggtgggggtagccaggggatctgccgaggaaagctggggacagcgggcttggtggcgcggcccggcgcggcgcgtgcctggggcgcgtggccggccacagaacccggggagggtggaggctcccgggcacgcgccggggtggtgggcagcccgggacggcagcggcgatccgtcacctgaggaggggcggggacttcatcgcggccaggccgaggcgccgagggtcccttgcggcttccgcccctctccgctggccccgacgccgcgctcgggccgggactcgagccccggttccgcggggcaggctcaggtctgcgcgctgcgcctgcagccgaggcagaaatccgtcccgaggcgcgggcgccgggtccgggtcccaaggatgcgcgtcgggctccctcccgcggggacagccgagctccgccggcgctccaggtgttcccgcagtgcgtccgggcgcggacgcctctctgccctcggaggggaagcgggagggcccttggggtaacgccccgacctcgggcttcctaacctgggtcgacagccggctggcacagggaggcctgcgcgggagaggggcggagagagcgcagcgcggggcacagcgggcggtctccgtgccgcgcgcgcgactggaaacggcgtgcagatcctaaaacgagggttccacagagggccacgaggggcaggagagagtccccggagaactctagctccccgacacggctacctcttggcaaacgagcgagaattggggcgcagagccttgggagggccgttccctcggcgggagcggcccgagcacagcctcacagcagatgcgagcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgc

SEQ ID NO: 10954 - DNA, 324 bp, Homo sapiens
cgacctcccgagggaggagacagcgccgccctcttacctgcacaggtgctcccgtcgtaggtctcgcacacccactcatggcactcacacaggggcccgaagaacatgcccggctcagtcacgtggcagatgcagacgccgcagtcgcagcggccccggccgtggcacagcgcggcccccgggggctgcccaggtgcgcggcagcgtcgctccgactcggcccgggacagcctgcaggcggcgcccggccagctcctgcgcgggcgacaagcaaccggcaggccgggtcagacgcggacgccgccccctgctccgaacccacgt

SEQ ID NO: 10955 - DNA, 1881 bp, Homo sapiens
cgcactcggttccgaagaaggcgtccctcggacaaaaccgaggaatctgtcctgctctgtaaggaactagggcttgctgattcccagattttaacgagaatccctgctccccgtaggcgctccataaatttttactggacaacttcaccgcgcgctactgggcctccgggagacccgtgactcccacccgctctgggcgcgggcccgcagagcctcaacccgcgcccccggcagccgggattccccgcccggaccggctcccaggctggaaacatcatggtccgcacccggggcgcagccgagacccaccgcgccggaggccccgggacccgctcagaccgctgcttggccactctacgcccctgagccccccacacagccagccccgtgacctccgagccccgtgacctccgagccccgtgacctccaagccccggaagccgctgtaggcagcggcccagccaggccccgccccctccaccggagctccacgcgtcaattccagccaggccccgcccccggccgccccaggcgtggacccaagccaggccccgccctctgcctggctactccaggcgcccaccgccccaggcgtcctctagcccaagcccaatgcccggctgctccagacgtcgacagccccatgccccgcctcctaatcggctgctgctggcgtcctctggtccaggctccgctccctacccggctgctccaggcatcctctaggctagaccccgccacctaccggccgctccaggcgtccgcagctccaagccccgccctccgcccggctgctccaggcggcctccggctcaagccccgccccctgcccggcggctccagaggtccgcggctccaggccccgacccctgcccggctgcacaaggcgtcctctgggccaggccccgcccccagcccggccgctccaggccccgccccgccccctctgtgcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaaggtgggtgcgaacgctttaaggcgccattttccccggctgtccagtgggagtcggggaaagcgggtctgaggtgcgggggacgtggggcgtgccgggatcgcggggcggaagcgggatcgacggcgcctgtgccccgaggggcctagggcgcctgtgcggcagcgctcgcggcccggagtcgcggcggggcagccggggggcgcggggcggaagcgaggtcggtggcgcctgcgtccggaggggcctagggcgcatgtgcggcggcgcgcgtagcaagtttctaacaaggcgggctccaagggtcccggcgcctgttggccggatcctgtgcgagcgcgcgcgcgcgcggatggtgcggggccctccaggccgggccggaggcgcgagcgatttcgcagagccgggtattaggccgcgaagtcgcccaggcggcttccggggagccgagctggggtcagaggcgcgcggggaatgcccgggcgcggtcgaccttctggttccgcacagcctcgccagtagccgagggccgcgctgcggacgagctcagccgaggagcaagcgccccggcgggactggaaggccccgg

SEQ ID NO: 10956 - DNA, 944 bp, Homo sapiens
cgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggccgcgcggggcaccggcccaactcggaggggcggcggctgggccctggtggatggcagcgtcgccacacgccccctccccccagacccgtcctctaggccgggggcggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcggaaaacaccgcggcctcggcctccagaaaccccggccttgcgcaatcccccgcagcccgcgcctccctgggccccacgcgg

SEQ ID NO: 10957 - DNA, 1514 bp, Homo sapiens
cggagccgaatccggtgctcctgttcgcctggggctccgccagcgcgccgtaagctcctccagaaacccaaattctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtccggcctctgcgcgcgcacaacaggcggcacggcgcagcccccgggagcgcgggactcgggtgctagtcccggcgcccagccacagcgacacagacctgggtgccggggcccgccagggagccctgtgatccggggacctccgcgatgcagagaaccagggaccgcgcacggagcccaggcgcgcagtctgcagccaggaccagcctcccgcccccgccgctgaagccgccccgagctccacgcctcccccgctgccgggctcggctgccctagggcctcgtccgcccgtcccagagtgagcgacctccgactcacggagaagcgaccttaccaccggtgcccgacacccagagctaagggagcgagaagaaggcgaagaaagaggcggagagcggtgcactgccttcgctgggactcgcgacttccagaaaccctcccgaaacccagtcccgccgccgccccgccggcagggggcacagcgggcgtccggggcgcggcggctgagcgatggggcgagcggaaagggcccagacgcctggttcttgttcatacctcggagaaagtcttgagcaccaggcgttgggctctctggtcacccctctgactcttcctaccggcgccgagcctgccccactcctctcagccccttggccccgccagccagaggggcgctccgcgtccgccccgccccccacccacgcctcccgacccgacccgcccccccgaatccccgccccctgagaccccgcccccgacccgccccaactggccgcggcggcagccgagccgcgggagctgcgcgctgagctcgcggcagtacggggagcgcccgcccgccccgccctggacccaaccaagcgtcccgcggaggggtgcggccacttgggggcaggagaaagcggagtacgccacccctctagggacccaggaagcgaggcgagcctcaggtggacgcggtggtgtggaccacggcgatcagggcctttccccctgctgtggagacggaggtgcgaggggacgccggcggctccccaccttctggccgagtggccttctccgcctccggctggactccctcggggcgctccctccagagccgagtcgggctggccgggggcggctgtttggcctgagtgtcgtcttactaaagcggaacgccggaggggaggccactccgagagaaggcggtccccggcggaggtggcttcgtgaatcctgcagccccctgcccgcccgccactcgagacgccgcgcctcgtgggtttcacgctggatggagggggcgccgccga

SEQ ID NO: 10958 - DNA, 2144 bp, Homo sapiens
cgcgtctggatgcgtttctcggattcggctccacacaagcctcagccctccggaccttgcacctcccccgcggatctcctcacccctccacccccaggcccagatctttccttgtcggaatcgccacgcttcctcactcctttacccccgccccactcggctctcctcttcctggtcctcatccggccaggctgccccgccctggtagttcccgagggtcgtccgaggctctcgtccaccaaccgcccccgtctggaagaatgcgcccgctcgagcgcactctcggcgggtgccaaagcctcccgcctcaacaggtgcccctgcctggccacgcacagctctgtcacctggggctcggacggagacggcgacaggatcgccccctgcagggcggctgcggctccgcacgcccccgcccgggtccccagagcgccaagggcccccgcagccccgccgccgcccccgctgtgccacactgcctttgtttccctgcccgcttagatgtcgcgaggctgacttcatgcaagggtatcgccaagttcgggcgctgacactgcccacctacccgtggtggcggaccctaaggttgggagtgagagacgcgtacagtgcgagacctctcctcaacccagagaactccggggaagctgggtgtccgcgccgaagaagcgggttcaagttgacccggctcagaagggggttcgaagccaggcgcagcgcctagagagccttcccctacccacgcccccacccgatgtcctctgcccccagaaggctggagaggggctgcgcactgccacctacgcgctcggctgcgagtggttcccaccgcccgctcgccgcgcgctgggcccggcagccttccggggcacacgaggctcccgcagcccccagactcccggccccggcagcgcagagccgggagagccgccacgttcccagccgcgcgcgcacgccgggcccaccaaacttgcagcactttctcccagcccccaccctctgtcaccctcccttagtcggtgcgccccagccccgccgcccggcagaggttgccataacaacgggcaggaatgctccaacatatacaaagccggcccggcgcagcgggcactcagccctggccgggccccgcgccctcggccgccgcgcagggtctggacgcgcgccgcggctccctagccggccggccgacgctcggggcgtactcacaatgagcgggatggtgcggtcctcgcggagctgctccgacctcctgcctgccctctgcgcgccccggccgccggaggatgctgcgtgggctcggttgtcctgccataagtagtagaaagtgcccaggatccaggctacggtcaggatggcgatggcattggcgcggatcttcctcatggtgggcagacgggcgccccaggtgggggactgggccggcgtgctctcggggccggggcgggggcgctcgcagccccagctgtttgttttcgctcgcgcctagctgctcagtcctgcagagcagaaaaaggagagaggtgggggggcgggggggtgatagggagagacaggatcgcggagcgatcctcacggtcctaatgcccttcagccccgagcgcgcgcgtcccccgggcgcccattcattcgtgcgcagggccggccccgcgctccagccgccgccggctgacccaccaggccactgcgcactgggagagaagcgcgccgagtgggaagcggcgcgggccttcctcccgcgcccgggaacccggcgagacagacgcccgcggcggaatggcgactggccaaagccagcctcggctcccaccgctaggtgaccgaacgcccggcagctgcccccgcgcggccctggtcggtcctgccgacccacacccacccccggaccgagcggccttgagtcaccgactggagacgcgcgacccccgacctgggcccgcgccgcgagctgcagttccgggctgcgctctggcgcgggattcaaggtgtgttcggcgagtccttgtgtaggggcggctgggcgggggagagtcctgagtttgtactggaatctgcagctgagattagccagaccgggcccgcccagaggagggattggaagctggtgcacttgacattcgaagagcgcgaaggggaaacgacgc

SEQ ID NO: 10959 - DNA, 379 bp, Homo sapiens
cggtgcgggctcgcctcctcccagcccagcttccctgacatcgcccctttcctggggacgttgcctgcgggcccgcgcgtccccgcccccgactcccctgcaggttcctccgggggccggggcaggaccgcactcaccgaggacccgggcgctggagccagcagcagcggcacgagcaggagcagccgcatctcagcctgcgggagacgcattgggttagagcggcccggggctcccgcagctgtcctgggcgcgggcgagagtgtgtgggcgcgtctctccctatggcccacaggtgaccaggagacccgcaacaggacagccgggtgcgcctcggtgcaccgcagagaacacagcgtgagggcgccccgccgggcgg

SEQ ID NO: 10960 - DNA, 637 bp, Homo sapiens
cgccgccccactttcaacaagccgaagcctttgaaggaggctcggtgccatctcggtgtgatcgcgtcccggcgacgctgggtagggtgcagggagccagctcggccgcggctcagcgggaggggagggggccggtcccgaacccgggcgcccgggccgcgggtgattcactgggaacgccaggttcgcgcgcctagaccggcgggcgacgcccagcgcgccccacgtcccccgcccgggccgttcgcgcagaagcagcccccgcgcacccctgctccccgagacggacccgtcgggaaggagcctggagtcgggcggccggcgggcagcaacctctccctcctcagccaccatggccggtgcgactccctacccgcgcccgcagacggacttcctggaaagcaccgggctgggcttacctgactggcgcccgcaggggccgccgacctcttcacagacccacggaaactgccggccgcaagccgaggctcggttcccagcacccgccggtccgcccgcgtcggcctcccaaagagttgccagacccacccgccagcagctccctcactcgaccgccctgtaggtgcggtgggttcctccttcgcctccgacgcgcgtgcgcactcccgtgccgcgg

SEQ ID NO: 10961 - DNA, 959 bp, Homo sapiens
cgggagtggggcgggcaggaacgagggcctgagcccaggaccgcaatccccgtgaggggctcgaggaccccagcccaacgccccgccgggccccgccctcacctcctcctccatggcgagtccgccgaggtcccgccgctccgccactcgcttccagcgccgcgcgggctctgccaccgcgtctacgcccggccaggcggcgactctccgcgttctgtcccgccggctgccgggggcccaagaaacttcgggggggcggggccgggggcggggtgaggcttccgggggccggggcggggccggggagggggcggtggggccgggggcccggcccagggcgggaaatgggtggggaggggcggggcctgggttggagactggacggaggagccgggcggagatgcaactggaggaagagggcgggacggggcggagaaggtttcccgcatcggcggagggagagggactaggagggggctgcggcgggggaggagagggggcttccggcccagagactgaggcgagggtggcgggagcggcgcgcaggcagggctggggtggggcgcacacagtgagcgctgggggcgctggcggtggagcctttgaggtctcccgaaccagtgggctggggttgcgagaccgagccgagctgccctgggcggccagagatgtgggcacacagaggctcctcctctttcctccccgacgccgggcagtgggcggtggcctggtcttctccctggaacctctgggcggggccgggcctggagcttgggtctctgtccggagggtggtgtcacaggaagagctggagctgagagtcgggactccggggtccctttagggggcggcccgcccctggctctcaggggtctccaagcgcagtgttctcctgctctccttgggcatcgctcaatccctcccgtatctgagggtcgaccatccccccgatcccgcgg

SEQ ID NO: 10962 - DNA, 826 bp, Homo sapiens
cgcccatccctgcggcgccgtgaaagaaggcgcaggaggagggagccctgacacctcctctcgggctggggccccacagcggcgaaaagacggagggagtgatcgggggtcgcggggatccttccgggacgggcctccgtcggaggagctccggaaagccgccctccacctccgaggccccgcctgcgcgggcgctccactagcggtcggggtggtggcggcggcggcggcggcggcggcggcgcggggcggggcgccgcgacccctgtccctcccctgggccgagcggcaggcgcgctcgcaccgcccccgccccctcgtcgcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggtaggcgcggcggctggcccgggaggtgggccccgagggggcgccgggccgcgcgcgagttcggggcgctgactgcgcgcgacaactcctcgggcagagggggttgagtcagccccgccgccggggaagcagctccgggccgagcccctgagtcagaaccggcccgtggaggcagccggtgccccagcccgcagcttcgtcgcccaaccgaggctcccagggctggcggccgg

SEQ ID NO: 10963 - DNA, 2156 bp, Homo sapiens
cgtccgaggaaccggcccaaccgctccccgctgcagccggcttgtccctttctcggaactaccgagggagaggcgcgtgcggaggtcggcgttcggatctcgcatccgtcactgttgccggcgcatttcctcgaagtcttacctcgaagggctgggtcccacccgcgcgccctgtgcgtgtctccctgtttccccacgccctccttgcctggctgctgcgaggctttgcaggggaaagactggcgcggggttcgcaccctgcccatgtcacaggaaaaccgtgggagcctccccgacgcggcgcatttccggaagccccctctccaggagggttgcgggaaggccgggactctgcatccagacgaacccggtcgcctcccaagaggaaagtcggagacccagctgaggggcaaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccgg

SEQ ID NO: 10964 - DNA, 1441 bp, Homo sapiens
cgtaaggaggaaaacgtggaatcgaatacagtagctgcgggaccgcaccacgtgatcctcctcccgcggtcgctccatagaatttgtgggaaggggggggagggggagtgtcgccgcaatcccgaggacaggtcagcagcccgcgggtccgactccagccggcgttcccggggttaccacaccccctcgccggcggggaaaccatactccttacacgcccgaagtcgccgccccctcgacacggctcgcccggtcgcacgcacacgccacgggccggcgcctcccggcacacgcgcgaaggccgggccccgcctcgctccccaccgactccgcggagcggcgaccaccggcctcaactagccccggaccccgggcgcgctcgggccggtcccctccccggcccagcccccgctaatcgggggatccattccgctgaactcgcccactcgggagggcgcgccttcgcctcactgctctacacccgagggcaacagcggtcgtaccgctcacctgggtcggggggctcctccctcgctctcggccgactgagccgggctggggccttcgaggaagcgcgggccgccgggcggctggaagtgggggaaggagaggagggggagggggtcgggataccgggagccgcctcctttctcctccgccgactgcggctcccgcaggctggccgggcgtcctcgcacactcgcccagtttctcacagcctcgcgtcccgtcagcttctccctcaccccactcccacacactctcactcccacacactcacacccggccgctcctcgttccctcactcgcctgccgcgcgcgcgcgcgaccccgctcacacacagcgcgcgcgacgccggcggagaccgccccgctccctcagaccgaacgccgcccgcccgcttgctgaggagcggcgcgcgccccggccccgccctcctggcgccgcggcgcggcgggcggggggcggcggccggaggagctgggggccgggccagcgcgccgagcactgccgagcggatctgacacctgcgtcgagagccgccctcccagctcctcgcccgcacccgagccatcgctggcctcgggggaagagaggcgatggatcgcgcgcggggagcgaaaagggagcgcgagggcgctccgaggacgcgcctccccacccgcccccaaaccgtcttcactgagaaagggaaacggatggggggggtggggggcgaggtttgctcccaactcgaaaccgcgagattagtcccttccgttgtacgccctccccgccctcacattccctgcttaggccccatcaatctgcgcctggaaccccgacacgagccccctaccccctcgggcgcagggtcctgccggcatcccgacgcctcccgcccagcccttccgccggccgccgcccggagtctccgcttacggtggttcctccctccgg

SEQ ID NO: 10965 - DNA, 734 bp, Homo sapiens
cgggccccgcccgccctgtctgcgggccgactccgcgacgccgaccggctcgcgcctccgcccccgagcgccccggcgggcggagttgcgggtgaggggggggctggtttggggggcgggggtcccgatgacggcatcggagcgcgccgcactggggatggaaacctgactgcctggcccgggacggcgcttgcagccaggcaggtgagtgtgggccggagagcgggttaggggcgaggaccgggtgggtggagggaggcgcgcgctccctcctcgcgcaggcctgggcctagtggccctgggagccggcactcctgggagacctgacccggcatgaggagcccggcacccttgctccccagcctcctggaagctcttccttggactggccggcgccgtcttcccgacatctgggggctgaggccggcatcccgggcctgcgtggaggggcgagcgccaaggctgcgagagtcgggtcccgatttgtaatcacttcttccaactttcatggagctccgtcccgcgcccgccgcctccagccccagctgccctgccccggctccgaatagcgcctgcggggttgtcagagcaccttcggagcgggagcgctgtgcggagagcaggggcgcgcggaagccgggactgcaccgggctcggaacgctcacgcggaggggtgcgcgaaggcccacacggtattgcgaggcagagtttaccgctgtgtgcccagggtcgg

SEQ ID NO: 10966 - DNA, 935 bp, Homo sapiens
cggcggtgtccagggggagagggtcccagcgccgccgcttcccaagccgacccgtccgcacctggtcccttccccacagggctggagcctggatgaagtcccccacccctgccagaccccagccggggggtcggcgccgcgaggtccccatgcgcgcccccaaagttgccgcgggggaggggctactccccgcccggggctgagaccagccgagccccccgcccctgcccggcccgctcacctcgggcgcacagcgccagccggagcagctccagcagctgcgcccccagctcgcacgcgtccaggcccagcatggcggcgcgcggcccgggcgccgcggagccgccgaggagccgccgcccgccccgccgccgccccgctcggcgctcagccccggcgcgactgcggtgagctcatcccggccgggagcgccccccgcgcccagccgcgcccggcagagagcccccagccgctccggaccccgcgcagccccgcagagacgcgcgtgtcgcccgcacgggccggcacccgggtcgcccccgccggcgtgccaggaccccgcacagaagcgcccggacgcggacgcacgcagccgcggtcacgatccccgccgcccgcccggcccgtgcccggctctggccagcagggctgccccacccccacggcgcggcgggagcccgagggggtctcctgggaaaccctctgcggggcgccgtggcgcaggtgcgcccccatccccagggtctcattatccgcggccacacctggggccggaccgcgcgcccccttcccctcccccgctcctgagggagcttctgtctgggccgagggggactccgggggcctgcccagccttggggtgaggggctggcccaacaccctacaggttcacggtcatcagtagggcgggaccacagtgggcgcgggtcgcacgc

SEQ ID NO: 10967 - DNA, 1054 bp, Homo sapiens
cggggtgggggatattcgggctgagtcagtcaagccgggagtgtgaggagcagcgggggccggcaggaacgtggacgcgagattggggagcagtggggctgcctgtgcggggatgcagctcccaccaagcacacgggtcgagggctgaccacaggcagagcagcgccttctggcagcgctgcgggtgtggatgagggaagccaggccccggacccatacccagacggccgctcctcagcctgtcccctccctcctgtgggctctcaaagtgcggcttggtttctccatctcgaccctgaggcctggaggtggggacgggactgtgggcgccggcaaacgtgagctcccgagcggggcgggaaaggagccccgcgaatgcctcccccagccccggcgctccacgtgcaggcccatgactgggagcgttttcaacctaaatcggcactgcgccgggattattcctcccctggcgccgcccccgccgcctcctccggatccttcccggcttctcccccactcttcgcccccggggcccctccctgctgagcgggggctgccgggatttgggattgcggggctgccccgaccccgcagccgtccgcggtggaagccagcccgggcctggccctgagcgcgcggctggggcggccgctgtccatggtgctggcgcgggtggcgcgccggccggcggggtctgcggaggcccaggcgtccctggcggggaaggcggcgcttccgggtctggggagcgagggtccccgctctaggggcacggaggatatttagactggggcgcccgtgggcctggtgctgccgcctcgggcgccggcatcctgcgatatcccctctccccggctctgggagggaaccgaggcagccccgcgccaggcctccccggacacctggggcaaattcgctcctcagagcctcgtgttccttccccaaacctgaggtagcgacccctccacccctaagggcggccgtgaggtcgaatcatgtgccgaccccagccggcccttgcaaacgttgtgatgtcggcctccggaggccgcgc

SEQ ID NO: 10968 - DNA, 1474 bp, Homo sapiens
cgccagcgccgatgctgctgtctccccgctccctccacttccacacactcccacccgggtctccgcgggctctccgaaccaagccctcagcccagctttcccaaacagcccacacagcgacacgggtattgggcaactgtaaccagctccaaccggaagtacctgcctgtgggtgagacccacctgaccctcggggccggccgccataagggcgagggctgaggacctcccgtgggggacatgggctccccaccagccggaaagctccagcgaccggctgggcgttcctgggccggacccgcgccgccgcccgcgcactggggccttcgaggtgtgatgtcacctgcccgcagaatcggcccccctcgcgccgcccccctcgcgcccccaccccagcctccctctcgccgctcccggggctaatatggcagcggcgccgccgccccacccccgcaaccgcacgacccggctggcagggccgccggcccggacccccgagactcacaccccggccaggcccgcacgccctgcgccccggacccccggcggctccccgcagccctcggggcgccgacccccgcccgctgtcacacgaggcccgggcgcccccgacagctcgggattacgtcagagtgacgtcacacaccggaccccggcgagctgcgggcatgagcaacgcgcgcgcccccgcccccgagtccctcccgccgccgcgctcaccgctgaagaccatggcggccgaggcgcccatgacggcgaaaaacgaagcatactcggggccgctcttggactcggacatgtctgcgggtggggagggggcaagctctgcgggccgaggcggtggcggaggcgggggcgaggacgggccgggcacgaaggtttgcgggcgggcggcggcgaaggcgatccggcccgtcagccgctgcgctctaaataccagcaccgcagaacaaaatggcggccgcggccgcgtcacatgacctgggccccgcccctgcgagccgtaccacttcgcaccgtgggggagacgcgtccccgggacgcccggccggcccgttgacctcccccgggctgtgccgcccgcccagcgacccggccccggcgcccggccccgccctgcctcggcctccgcgggtgtttccgggcgccgccggcctctggatctccgcagcgttggaccggtctcgcgccggggcggggcggtgtggtgtgtgcttcattagcatacggggcggggcctcggacgccccgcctcctctgcggctgcgcgtcgtctgcaggtgttgggttcccggcgacgcttttctttgtacccctggcgtgaagctgcaggccgtggtttcgcggccttgcccccaagacggggcctcacccctccgggcgctggtcttccaggatctccctaccaatcctgggcgagctaagggtcccagcagatgtgcggcgcgcgggcctcctctgccacagcgtccgg

SEQ ID NO: 10969 - DNA, 357 bp, Homo sapiens
cgggagaccccgagatccccggccggtgacagcaggcgaccccctgctcctgtcaacctgtgggtccctacggacgtggggaagggaggagggaggccccagctccctgcgggggaggggcgtgaagacgcgcgggggtggggggagatgagccggcgtcgccatgacaacgaggccggtggtccggccttggggacccgggagggagggaggcgccgtggccgcgcgcgcgggcgggggcggggggccaggtctcccaggagtagttggggaacacccggcgattctggcggctgcttcctggtggcgcagggagcccgcgtgtttgcgagtgcgtgtgtgtgcgaagttctccgg

SEQ ID NO: 10970 - DNA, 814 bp, Homo sapiens
cgccgtccaagagcctggggccgtggggggcggggctgcctgctatcggccccgccccgccgacaggacccgcctctctccccaggcccggcggggccgaccccgcctctcgctcccagcttgccgtacgacagcggcggcgcggcgggcggagccgggaggcggggaagcagtggccgtgtgagcgtgaggagctgccgccaccgcctgctcctcgtcctcctcgtcctccggggccccagcgtcgtgggccgcgcacggccctggaagagacgtcgcctcgccttcatccgcctctctcaccgcgccgctccctcgtcctgccctgcgggctcaggcggaacccggaacggccgtcctcttcccccgccctccgccgccgcctcctcctcctccttctcggcttcctcctcagccccgggccggagcggggtgtcggcggcggccggttcgggcggcggcgcttggccatgtcgtgtcggggaaggtaatgagccgcagagccccggggtctcggctgagcagcggcggcaccaactattcgcggagctggaatgactggcaacccaggtgggtgaccggcccgggaccccgccccgacctcccgggctccgcctcgggcgggccgaggcctagggccgcggggctgggaggcgcggcctaggccctccacccaccggagccgggcgcggcttcctgggtctcctcctccccggctaggggaggaaggccgcggggaggcgaggcctaagtgcctctcccctccctgcttgttcagcccggggctgaagccgagccccggggctcccggcgg

SEQ ID NO: 10971 - DNA, 847 bp, Homo sapiens
cgtggtgagacaccgactccgcagagcagagggggcggcggcagaggggaagggtccccgcactcactcttcttgcaggaggtgcatttgcatccctcgcacttgcaggagtccgcgcaggtgcaggagccacctagagagggcgacgccacaggaagggttaatgtggacgaactcgggtccccacgcctgtcacgaggagatggggtgccaagtctccctgttctccgcgacacaggcatgcccgcccttcacgaggtgaagaatagggaatcaggggcccttcccccaagtgtccttgagcgaaggcgcagggcgtgggtttctttgcaggtacaagggcgcgcagtgcgcaggatgcgagcgggggcgggggctcaccagaagggcaggggcaggtctcagggtccatgtcgaggagagcagcagctggaggcggtgaacgggcttctccaagcaactggacgcgcggcttggctagtggcagcaggtggcgatgcttttatagcctcgggcgggggcgcgcatgccaagcccgctgggcgcccgcccctgcgcaccgcgcccgctctttccgtttgtgcgcttgggctccggcgcacgcactgcatctgtcgcccgcccctgccgtgtgtgtgcactgccggggcccgctcgcccacgcccgcgcgtgcgcccccactcccaccccgcatccgcgtgcacgacccactcgccgccgctgtgcgcgcactgccagcccactccccgcgtgggtcccgcaggggacgtgctcgccgcagcagccgccactgcgtggaagcgcgcacgtaccatctccgaaagtggagaaaaaggcgctttgcgt

SEQ ID NO: 10972 - DNA, 589 bp, Homo sapiens
cgtgggtgctccggaggaaacggccgcagccccaaatctcctagtctctctagcagggagttttcccgcggagtctcgcctggcggccggaagccacctcaagccgcccacccggaagccgtcgtcttggcaactgggtatcgtcccacccccttttcttagcaacgcctatcgccttagacgtctgaggtcagccgagcctcgattggttcctctgtctttcactctgggagacgtttgagacccagcgtctctagatctcgtatttgaatttgtggcgcttggtgtccgcgagttgccgaatgaagctgagcgtctcagtggaaccagggatctcaggggtgagcgaccgcgaggggagagcgacgaaaagggcggccggagctggaggggcgcggagttaaacaaaaaagggcggccggagctgcaggggcgccgagttaaacacgtcatttccagatggggggcttcaggcgagctgcttagctcccctgaggcaggccctccgtctgttcgccttttcgtagcctctgagtttttccctcacgtcgttttccggcagtcccagagacgccacgcctgcccccgt

SEQ ID NO: 10973 - DNA, 848 bp, Artificial Sequence
  Description of Artificial Sequence: Synthetic polynucleotide
ayggggtygtattygagtyggyggagtatttttagggagggggygggaggttttttttgtttagtttygagtyggtggtgtagygttygttttyggtygygggygtagattggyggtygttttygggttaygtggtgygygyggygggygygttygaggagtttgyggttgtttttggtttatagygtttygggygaggagagygggyggaygtygggggttgggtyggtgygggyggygaggtaggyggaygaggygtagagatagyggggyggtyggggygyggtagtyggyggygtyggggtygyggtttttgttttgtygtttttttygygtyggattttygygtttagggygtayggtggagagggaygyggyggagtyggtyggtagttatggaatyggtttttttygtyggygtygagttgtagttttygtttttygttaaygtttyggaygtttattttagygtttgttttagygttggygttaatgygtyggggtygttaggygygyggagygtttygtttttygttttggtaatygttattatygygttttattyggtygtgtgygtygtggggttgttgggtaaygtgtttgttatgttyggtatygttyggtgagttygttgygggtyggygtygtagggttggagttyggggtgagggtggggattaygaatttgagattttaagttygttttttggatttttygygttttygtattttttgtaggggtatttggggtttagygagaggygaggttatttatatygaggggaatataggaatgtgtgttatygtgtgtatgtgtgtgtgtggtgygggggggggagtgygtygyg

SEQ ID NO: 10974 - DNA, 1230 bp, Artificial Sequence
  Description of Artificial Sequence: Synthetic polynucleotide
aygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygttyggygtyggagttatgatttttygtygatttaggaagttgtagtagaaggaggaggyggyggttatttyggatttygtygttyggattttygattyggaagtygygttygtygtttyggtttygatttygggattttttgtygtagtygttatttttgggtttttagyggaygagttgtaygyggygttggaggattattattttgtygagttgtatygygygttygtygtgttygggggtattttgtttygtygaaaggtgygtttttygttygtttttaggatttgtttagttttttttygattttttatagggtttgttgatttygtagtgtttttttttyggygttygyggagttttttattttttttttyggttygttgggtgtttygatttttygygtttttygttgttgygaaggtygtggttttygtttgtatatygygtttaggttyggtggtttttaatttygygttttatgtaygttttttttttttttttttgattttttttagtatttttttttttttattygttttatttggttttttgttttttatgtttygttttttygtggttaggtgttttgggtttttaggagtttttygttygagggatagagatagttttaggtaagttgaaggttygagagttttyggtgggagaagygggtyggtggttgygtygygtgygtttttattttgaggaagtgygtggggagtygttgatttyggatagtatattttttygaggggatttttygatttttgggttgggggtttgtygtttggttttaygtttgaygtayggggygygagggttattgttttttggatttttgtyggaatyggaygtagtgggaggggtygtagggygttygyggggtaggaaggatgygggtygyg

SEQ ID NO: 10975 - DNA, 1094 bp, Artificial Sequence
  Description of Artificial Sequence: Synthetic polynucleotide
gyggygttaaaaatagttggggggagggtgygggggyggyggagtttgtaatttaagtygttttagttttyggggggtagatttygyggtygtyggtyggygttyggtttttttagtattyggtttagggttggagttggttgtagggttggttygyggygatttgggtagggtggyggttgttttttttttttttatttygtttygaggygtagygygyggtagagyggttyggtgttyggygggygggyggttygggygggtttgyggtygggatgaggayggygttttygttgtagagygttggggyggygygggtygggagttygttggyggyggtyggygtggygggyggagygggtttyggagyggaggtgagtgyggatgygtygtttgggygygygyggtgtttggggatttygggttggaaygyggggygggggtgttatygggttgygygggggttttyggttyggttttygtttttgygttttygggggtygtttttyggyggggtyggatttttttagygttygyggygttyggttyggttttttygatttttttttttygggttyggaygtgyggggtagygagygtyggggttyggygggggtygtagttttgttyggagyggagygttggtagygyggggttyggtttygtgggtagtttgggaagygttygggtaaygtattggygagggtygyggagygaggggttyggggagygggattttygggyggggttgyggggagyggggttygggtygttttatttatygyggatyggagtygggggtgttttagtygtgtygtygtttttttygggtygttygttygggygtgttggtttygyggygtttygagygyggtataggtttgygagtyggyggtgttagygtttyggaygggggtgggagttttggagtttattttgggggagattaygtygtattttygtttagtttygygtatttttagaggtttttgtagagtygggaagttggttggaygtttagattygtggggaygyggygtttygygtggyggyggtyggaagggaaggttaatggggttygggggattttygyg

SEQ ID NO: 10976 - DNA, 1979 bp, Artificial Sequence
  Description of Artificial Sequence: Synthetic polynucleotide
tygttatygttatygttttttttttagttattttttatattygttygtttattttttttttaatattttttatayggttgttygtatttttgttttttttyggtttaygygygttttttgtaatttygaygtttttaggtttttagttygtttttttttttyggttyggagttygagagtygtttgtttttattttaaaatagygataataatagggaygttgagaataataattaygattagtayggygaaggygtttttttygygggttagaggtyggygttttagtttygtagaattyggygttyggttagygttttttggtagtttttttyggtagttttaggtttttaagatttgtaggttygtttygaagtttttygttygttttttayggtygtttygagttttygaggttygtttyggagttttttgttygttttttayggtygtttygggtttttayggtttttaggttygtttyggagtttttaatyggttttttagagtygtygygggttttyggttatttaggttygttyggagttttygttygttttttayggtygatttaagtttygtygattttttaggtttttttyggagttttttatgggttttttayggttatttygggtttttaaagattttyggttgtttygaattyggattygtaggttygtttygggatttattattggttttttaygatygtttygggtttttaaagattttygtttattyggtttygattttttaggttygttyggaggttygyggygtagtttygtygtyggggaaggtttgtaggtygtaaggtygygygaatgtttygtgttygtttygattatygtttttagattagyggygttttttatygtgtttygagggttgygyggtttygygayggtttagyggyggggygygggygttgtttatgtagttygyggtygygtttttygggtygygyggttygagyggtaaggyggyggyggyggyggygygggttygggttyggtagagttgygagggayggygggaggygagttygtttttygggygygtttayggttygggygagagtygyggttttyggtgyggaygttattgatggggygtttggtygygggttyggyggyggygttttttyggttggggttttyggtttatygygtatygttttagggyggtttttggttttaggatttagyggyggttgyggygggagtyggtygtatgagaygttttygtttattggttygtygtattygttatygttattggttygtttyggtyggtygtaggggttgtgtaygttatagygtygtgagttagtgygttaatggagtgaaggagagaggygggattgatagtttttttggyggttyggaggygggattaggaggaygtttyggtaaygattgggtagggttttgygtaagggygtatgygatattggaagtagygagtaattggattggttgttttygtygtaaaggagggtgggttttgtattttygggtttgaygattggtttttttaagtgtyggaagtaatagggatgtygtttggaaataaaatttggtattgaagygtagggagataaaaygtttatttttagagtygaggyggyggttgtttgtygygtgttygtggttttttgtttgttttyggatatttygggttaygttyggttyggttttyggtygygttgttttaaygggygttayggggtatgaagagttttgggyggttgygaggggagggtatyggggtagyggggyggtygttyggggttttygygyggtgatttttgttttgtygtygaagagaayggttttygggygygtygyggtygyggttttagagtttttgggtttygygttttgagagtttgagtygtttgaggaggttaagygtttaygaatygtattttttgttttgttagttagttttttaataygygaaaaaggtagayg

SEQ ID NO: 10977 - DNA, 1930 bp, Artificial Sequence
  Description of Artificial Sequence: Synthetic polynucleotide
tygtttaggtagygygttgtttygggtttyggtagggtggggattggtygygaaggttagagaaggtaatggtaggggaggttagtttttgtygygggtyggttgtagagyggaygtttygttttgttttyggtttttttttygttygtygggttygtygtgtygaataattgttgttyggagttttygtgaygyggagttttaattgttgygattyggaagaagygaaaaggagtttttttygtttygtattttgagygttygggygtgtaaaygtgggtggyggagagyggttgttttttttttttttgtttttttttttttygyggygttttygtgtgtgygggtgtgtgagtgygtgtgtttttttygtttattttygtataygtttyggtattagtgtaggyggygagtyggyggtttttygttygttygtttyggtagttgygttttygtttygtttygtygtygtygtygtygtygtygtygtygtttttgtagtygtagtygggtatggtgagtgagtgaggtttagtygtygygygttttttyggttygtygtyggattttagttttaatyggtttygttttagggagttagtttgyggygggagygygttgyggggtygggyggttgggggattygggyggtygagttgygtttggaggggyggttygtgygttttyggttttaggygygtagggtygygggatttygttttgggagygggttttaygtttttttyggtttygagttttttttttygagggttgygygtatttttttygttygtttgttygyggttttttttttgttttyggagygttagtygttttatttygtgatyggtttttygttttgtttygtaggattygttyggaygggattaygtygtygtygtygtygtygtygttyggagtygygtttygggttttgtttgagtygagtygygygyggggtygtagttatygtyggygggggatggggttgtttaggaggygygtygagttygtagggggagygyggagtyggygygtagtttgagagttygagtagttygygtygggtyggttygtgygtatygygygtygtygtygttattgtygttygygtttygatggygttatygtttyggagtygttgatygtttagygtttttagttyggttygygyggygggtttttygagttyggttygtygggggagyggtttgtygyggaagttttttygygttttttygttyggtttygttatggygttgyggygttttttgttgttgttgttgttttygttggagtttttggatttgttgtttagygtttayggagttygyggtygygtygttaatyggattttgagtgtaggyggygttgtygtygggggtyggagggtygggggygttttggtayggggyggtygygagttgaayggtatygttygggygttyggaatttyggaggygggaagtyggygggggtagttygyggyggttgtggyggyggyggttagygyggtygttatttaygagaygtgttggggttattaygaygtgagyggttagtaygataaggagttygagtgtaataatagygagagyggttatttgtattgttgyggtatttgttattatygtttttgttgtaagaagygttaygagaagttggattagygttagtgtattaattattagagttyggtgtgggtatagaygtttagtattaaggtggtgtygtyggggttygagaataagtaygattyggagaaggataagattaattttatygtttatattatttgyggggtgatygttttygttatygtggtyggygttttygttaaggttttttaygataaggtttatygttttttaygggagatgaatatttataggtgagagygtygygtgtygygygtttyggttttttygyg

SEQ ID NO: 10978 - DNA, 3177 bp, Artificial Sequence
  Description of Artificial Sequence: Synthetic polynucleotide
tygygttagtttyggggtttttattttggygggaagggtaggtygattyggtagattgyggtttttygggagggaagaaggtgttagaygygyggagtaattataaatagttttttttttttagaagayggtayggggtttaagatttaggygtygtatatttagaatgagagtagagattttygttaggaaaaaaaggtatttaggggatttgtttattagtatgaaatgtaaatgagttygttyggttttatttatataattttgtgtatggattyggygaaagggtaattagggagaygayggygtagtagttattttgttattttttttattttttttttttatyggtyggggygggaattgagaygattttaattttttgyggtggygggaggtgygygggggttgygtgggtggtgtagttttaggagagtgaataaygtttaggggtgatggttttagtaaagtgaggggtggtgatggaggttattygatttatttygtygttttttygtagtggygtaagygttttaaaattttyggagagggaattgattgatttattaggtttygtygtgtttatttttygtagatgttggggaagtgtttttyggygtttaattttygttgtttttttttttatyggygtttagtatattygyggygtttygttttygggtatttatagttttttggagtggygtyggyggtaggagagagttagagtygattgagttttagaattyggggaggtaggyggggtaagggtyggggtttgygygtgygtgtgtaygygtggaaagtataaatttaygagggttygttgtyggtagggttaaggtgagtgagtgaaggyggtagattygygaagttttagtttygyggatattttttttttaagttatatagggatttaagagaaattgaggtaygaagttggggggtggyggtggtggggattttgaaggtygagtygataaagtttagttttgtgttttygtttttttttatatattygagatttttataggtttttttttaggggttttygttttgtttygtagttttttttggggattygggttttgyggtttagygygatttgtttggggttaygtgtttaagtaygaagtttttgygtggagtttaygttttttaaaaggtttttaggggtaaagggatgaagtttaggagygttaatgtgaggttaggtttagygggttagggttaygaggttagggtygaagttttagaattgattygggagtatgattaataagtttaagagatttgtggaggttaygtttagattatgtttattttagtttttttygagtttygttygtttttttaagattgggtttttttagtttgaagttttatttttaggatatttagtttygtttttttttttttttagtttygtagttaagtttaattttagggtgggagattaattaggtggagatttgggatttygttttgggattttttggtgataatttttattttygtgtygtttgtttttttttttttttaggttygtttagagttgagtttygtttttyggttgttgtttaaattaggggtygtggataaaggatgtttggggtttgyggttttaygttaggatttygygtygaatattttgatttttygggttttttttaagggagttttaaagattttaatggttaataggaaagtgggttyggtttgggtagtagtttgattggttttagttttygggagyggatttaggggtaaggggaggggagaggggyggttttgggttttggggtgggaatyggattttagttgtggttttttttttgygttttygttygtattgttayggyggayggttaatgggygygyggttyggggtyggyggygttyggygattggttgyggggttgtttgggggyggggtygaggtttgaagttgaagtgagggatttagttgtggtgtgygyggggtttttygtygtygttttygttygttygtttygygtttyggtyggaggaggaggttgtggygtyggygatagttayggtagyggtagttatygyggyggttgyggyggyggtattttygtttttattttygttygggattgttttttattgttttttygtttttttyggatagtgagttygyggyggggygggggaaggagtygtttttattttttttaagtttatttttaaagagatttttttttttttttttygtygtttggygyggagtygggaygatgttgattttttagattyggttttagttgygtygygggaagagggggygttttttttyggattttygtttttygtygttgttttttttttygttygttttttyggggyggtttygtygaaggtagygtygaattyggtaatyggagtttgggygygaagygaagaagtyggaataaagtgagggggagtyggtyggttggttygggaagttttaggggygtaggggaagygggattygygtygggyggggtttttttgygtttyggygtttygygggtagtatgtttttgygggtagggggagttgggttgaattggttttttygggggtttagtttgygttttagagtttattagatgtgttttygtyggggttttygggttgygtgaggatattttttttgaggggygtygtttgttttttttyggatygttyggggtttyggttggttagaggatggaygaggaggaggatggagygggygtygaggagtygggatagtttyggagttttatgyggtttaaygatttgtygggggtygggggtyggtyggggtyggggttagtagaaaaggattygggtagygyggatttygaggyggaggggttgtygtattyggygttggtttyggtggtttttttttatttgagttaggatagtygttygyggagttggtgttttygtayggtttgtaatttatatttttyggggtaygayggttaggygyggggttagaagggggaygggtygtatygtygggggtygggggggaagaagatttatygttaggtgagtygaagtgagttyggagggtaggyggatggggggggggttgttagggaggggagggggtattagagtgggagyggagaygygagtaggtttygtyggtaattygggtttattttatttgyg

SEQ ID NO: 10979 - DNA, 2195 bp, Artificial Sequence
  Description of Artificial Sequence: Synthetic polynucleotide
tygttagtttyggtygttaagtaaatattttttttaggagttygagaagtyggtgtgygaggggaggaattagtttgaggtttatygttttagtaatttygggtgatttatagagtttagattttyggttgtygtagatygyggtaggtaygtaaataagtagttygggagatattttttttttttttagttttygtttttttattttgttattttttagttygtgattagttgttttttttttttttygygggygtttagggttgagtaaatatttygggtygttygtttygttattagttggtttygatyggygtatygttggygattttttaggtaattyggygttatgagaatyggtatttygagattyggygttttgtttttttttygygtttttagggttttggttaggtttaataattttttttttttttgtgygttttagtttttaygggtttttggygygggttaattaggtttygttgygggtttttaggattgygtattttatttttygygaggttagtagtttygggggaaggyggtyggaaaattttttgtttatygggttggataagtattagtttggattygttttttaatttttgyggtttagttttagtagatttttggggtyggaggggaaagggtggtaatttatagatttatttyggaatagggagtggggggtggggttggtgggaatttgattttttggaaaggayggattyggagttagagttaaygtgtttyggagygtagaggtttagggggtygygttaaatattgtatttyggggaataaaatygtgaaggttaattaggataagtyggagtagggaayggggaygtygggaggggagagygygtttygagttgggtagaatttggaayggttataggaaattygggygyggggtagtygggtygagggggatttttgtttayggtttagagtggtttggattyggtttaygygtgagaggagygtttggtgaygattttaygtaygtttggtgattggtggaggttttagagaaggatygtgygtgtaaaaggygaatttyggtgtgyggtgtgtttaygtgtgtaagttggggaggggagggggygtagaaggygtgataaagayggattttgttttgagtgtgygtttygtttyggttygtttttagygaattgtgtttgaagtgtgttttaygggagggttaggaygaaggtgataaaggttaggtgttttttayggagaygygttaaggtagtttygygygtgttygtaggygygttttttggaagaygyggtggggggtgygtagggttgtatttttatattaattgtttyggygaaggtygagtttagaaagtgagtgygygtgagtgtgygygygttygtatgygggggygtggtagttaatagtaataatttataygtyggtagggttagaaatttttattttttttattagtyggaaagtaygagtyggtttagtttggaggtgagtyggggyggggagggtygggtaggttttgtttttgtgtaaayggagygtaygtatttggagygyggygggygttygattagygttttgaatggaggtgatgtaayggtgatgtaggttttagtttattttygtygaaagtaaggagttttgtttggggataggttygygygagagygagtaatttagygygtttggtttagtttyggttttagggagaggtaggttttgygtttyggttygggtttygttattttagttaggatygggtttggtttagygtttygygtygygttttttttattttygttygtttttygtttggggttggagttggttttaaaygttgygttggagyggggtyggyggygagttttaggtaagggttgttgttttttygtttygtygttyggaagagtygggtygggayggyggggagtgggygagggtagaggyggggggattggatattttgygggttggggaygtygygttaatttygttyggtygttgaaagtttttaaattygagtyggttggggattgggggggtgggggagttyggygttgyggttygggttggagggaggggaaattattttataatyggggtttttaagaggagtttttttatygtttgtttttyggtgggagttygyggttattttttttygtgggtggygttttttttgtyg

SEQ ID NO: 10980 - DNA, 2063 bp, Artificial Sequence
  Description of Artificial Sequence: Synthetic polynucleotide
tygaggagtygtggaatggaggattayggyggygtayggagtatyggggaggaatygtggggtgygtaggygtyggagygttygggttyggttyggatygaaggtttgygyggtgaaggtgtggtgtttgtgtttyggggaaagggttgttttttygggggattgtttygtagygaggtttgttttgttygtagttgggygttttttggggagygattgagygtaagggygggtygggaggygygaggygagtaygatgttttagggttttaaggattygtgtgygtgtgygtgtgtaaagtggggyggtgtagggygtgtgtayggtaygggygagaygygygtyggtgygggygtygggygtygtygggygtaattatagtataaagttygggygtygyggggygttggttyggagaatttatyggaygygtagaatyggatyggtatttttttygttagtattttaaygyggagttatagygtttagggatyggagggtaggyggyggyggtaaaggatattaygtaagtttttaygtaattttttygagtagtgtaagtttttaggattggygygygtttyggttattyggagygygtatygttygtatttyggygygtttttygygyggtgtagggaattatagygygggygggtattaaggggaaaggaggaggygtggtttggtygaggagttaatgggtygggaggggygygygggggaggagtttaggtgtagagtgtygattggttagttygtttttyggtatgtagatayggtgggagttaygtgttaggggtygggaygattttttgttggaggttaaygyggggyggggaagggggygygagygtttygtttggttgaagyggggggaggggggtttttgttagttagagtaataagatggtygyggtggtagtttygtattttagygygayggtttygggagtygtagtygtygtygtyggtttygtygtygygtagttttgagygtygttygggtygttttttgatagggtagttttagygttygtygygttttygtygtygttatygtygtagtagtygtgggttygttygagtyggaggyggagggagyggagyggtttygygtttagtygttygtagttgttatygtygtygtygtygtygtttaggattyggatttygtyggagtygtatttygtygggygtgaggaggaggaygygtygyggygttgtyggggtyggatttggatttgtygggaygygtygtygtttattygttygygtygtygtygtagtygtygtygtygttygygtygggatttgagttygtggygtyggygttgagygggttttygtygttygygtattttygaggttttygggyggttgttygtgtygtygtygtygttaggttygygttatyggagtttygyggagtygtygtygtygtyggggayggagtttaggtgagygyggtagttygttygtttttygtygtagtygtaattttgtygggaggttygygggttttttgttyggtygagtygagtyggggygggygttggtttttagygattygygtgyggygttaggtttygggtyggtygggtttgaggggagyggygggaagyggtyggggtyggggygygtgtgtgttagtgtgagayggggttgtgtagaygttyggtgtgtattataattaaaygggagtggaatggagggttgaagatggatgtgtttttttttttttaaaatttatgtagyggtgaaattyggtttttttygggtagtttttygtagattttgtattggtgatggtaggygygaattygtygtgttttggtgtaggagttyggtgtygttgtttgggggaagagaaaaattyggggygtgttgygggtgggyggagaaggatttttgggygttttgyggttttgaaattaggtggattttttaayggtgttgyggattgyggagtaatgygtatgaggaaaaygagtygtataatatttgttttgttattagataaygtaattygagygtttggttgtygtttttgttttaagyg

SEQ ID NO: 10981 - DNA, 816 bp, Artificial Sequence
  Description of Artificial Sequence: Synthetic polynucleotide
gygttyggagtgggaggaggggaggygttgttygaygygtttttttaagttttygygttttttttyggyggyggttgttygggggyggtggttyggygtygtttttttygatygttttttttagggtttttttttygtgtygyggttaggttgttyggtyggyggygygttggaaatatgaagagaygttgtagttgyggtggyggtggyggttattgtagtttagagyggygtatgyggyggtyggggygggaygyggggtygggygyggagaagtyggggygggyggtagagaggtygggaygyggatygggtyggggygtttatagtygttygayggygtttagagagygygygtttygtagtttygygtttagttygtygggtatggggygygyggtagtygtttgaagtttyggtttggttyggtygtattyggtyggaggyggagggtagagygygygtttagttgttygggtattaaatyggagygyggygtgygggaggttttagagtaggattggaaatgttttggtygygtygttttttgtttagatatttgttttyggtttttttgttttayggtgagttttygagggttattygagygtttttagtyggyggaggtagttygggygtygyggagttygyggaggygtygggtttggatygyggtayggtttatattgtttttttggyggggygggttygaggggagtttygygtttgtygttttagttttgggagagggggttttgtttatttttygaggtttgggatygtttttttttagggygttyggagttttttgttgyg

SEQ ID NO: 10982 - DNA, 368 bp, Artificial Sequence
  Description of Artificial Sequence: Synthetic polynucleotide
tygttttttttatataggygygtygggaggtttygttttttggtygygygattygggtatttaygtttygygtagygtygyggtyggtttygygtagtagtattattygtattatttygttgtggtttatttgggaygygatttataggggygttgtttygttttgygggaagaggaggyggyggtygtygtgattggggygttyggttttattygtttatagaaygtttttaatattaggggtttgaaagygaaaatttygggaaggtattttttgatygtagattatattttgtagttgatttatatygtttaggaggtagtgagaaaagagggggtgtgtgtagtttayggaygtagayggtayg

SEQ ID NO: 10983 - DNA, 1411 bp, Artificial Sequence
  Description of Artificial Sequence: Synthetic polynucleotide
gygggtttttatttygtygttaggagttttttttataattttgagaatyggggtgygaagaaagaaagggygaaagggtygtttaatttttagagagtagttagygaaagattygaggggttttttttygtaggatttygaataattgtagtatttttttagttygyggggtttattaaggagatttttataaataatagtatttgyggygaaggaattattttygtaaagggtagaagygttagattttattagttaattatttagaygygtatygygattygtaagttygggtaygtttygttygggygtaggtagygggaggggtygggtaygttygtgggggtggtttgggtaygggtttgattygggggygygttygggaggggtttgggtttgagtygggggygygttygggggagtgggttgggtttggggygggggygygttyggaggtgggggagtttggggtgggggygygttygtgggggtggggtggggtgtttggttyggggaygygttyggggaggygtggtttgggtttgggtygggggagagtygggtgygtgttttgggtttgygygggggagygygtttggtgtttagatgtttggtatygagygggtgggggaygtygggttyggagtyggyggtaagtttttttttggtaggtaataagttttttttgtagttttgaaggygttttggttagggttattttayggttygggtttttagagtttttttayggtttygaattygagtagtttttggtttttaattygtttyggaaaggtygtttttttttttaatgtgtggygygtttygatygttttttattygtggaataaaagagtagttttygyggagygggtttagagtttgttyggattgttygatggttttyggttttttgagygtygyggttgtygggttttgtgttygygyggggggygggaaggayggtyggggtttttagtgygygtttygyggagyggygygyggygttygaattggaaagttgtygtyggygtttgtygtttttaygtygttttagttttttttygyggggygttttatttattagttaggagattgggygtagggtygtyggggygggyggggggtttattttgtttttgatttttattgygttgtaatygtagaatygtaaggtttgagatttgtgaaaatttyggtttatggtttyggtttyggttagtttygtygtygttttygttttttaggggtygtagaaagattttygggggyggygtttttaggtttyggtttyggtttyggttygygttygtttggtyggygggttgttttyggtgttgygggttygagttgggttggtygygygttttagggattttaggggtygygygygggaggagygygggggayg

SEQ ID NO: 10984 - DNA, 1487 bp, Artificial Sequence
  Description of Artificial Sequence: Synthetic polynucleotide
tygtttttgtatttyggggaygtgattttttttttaggttgattygtttttygttttgtygtttttaggtggaggaggagttgaygtatttttagaagaaattaaaagggatagaggaygagttggataaatatttygaggatttgaaggaygygtaggagaagttggagtttayggagaagaaggttttygaygtaygtgtgtagggatgygggagttygyggyggggttaggtyggagtttyggggtygggaaggyggggagagtygtagggggaggaggaagaggaggaggagaaggyggygttttttagygttttttttaaataagtttygaaaaggggtattttttagtagttgtggttagyggtgtygaygttaggtttttttttagyggtgttgaygtyggyggttyggtygggtgattttatygtttygayggtagtyggttyggggggyggggagaggygggggyggttttygygtaggtaaaggtttggggggtyggggygyggttgtgtagttttygtyggagtygagtttagtygagygttygtygttgttygtgygtttttgygttttygygttatggtyggttttaattttttggaggyggtgaaaygtaagatttaggttttgtagtagtaggyggaygaggyggaagatygygygtagggtttgtagygggagttggayggygagygygagyggygygagaaagtgagygtttyggtttygggtttygtattygtagttttttttttygygygttttttttttttttyggtttttygygttgttygttygygygtagttttygggtygtttttttaygttttyggaygtygatygtygatttatatttttgygttygtagttaggattttttatttttttygtygtttttttttttgggtttgggataggggagggggygtygttttygggtygggyggggtyggttaagygggaaatggggggatggggyggagggggtgagygattttygggtggagaagtggagyggygggagggggygtatygtgtaggtttygatttyggggttggygtyggggtttygggtygaggggaattygygatyggatttgtgggggagaatgaggatgaaaaygtggagtttttattgtttagggtttgatyggtygatagggatttygaygggggatyggggatttggggagggggtygtattttttygtttttttygyggtttttyggtttttgtttgtttttttgatygtttttaggggygyggyggygaygtgtttgttttaggyggygggggggatggggggtggaggaagtttagttttaagtygttygtttttttttagttgatttttgygggaatyggggyggygggattttgtttttttttagaaggtttygggaaygttggygyggggttttgaatttaygatygtttgagygtttgttgtgygttttygtygygagtygtagggttyg

SEQ ID NO: 10985 - DNA, 602 bp, Artificial Sequence
  Description of Artificial Sequence: Synthetic polynucleotide
tygttyggttaagttattttttygttagtaggtgaggttygtgaatagttaagttttttttggtayggyggaatygtagtggaygygtggaggggtttygtagaggagggatttttgtttgggatgyggggagttgtagttttttatttgtatttagtttgttagttgtaygtttgtaggattataattttagtataaagtaggattgtagggyggtgyggatttttggagggagatagygyggtgygtttttgtyggttatgttggttggggtggtgttttaggyggttttagtygttagttatagggyggtyggattataattttagtatataaygggagtggaggtggtgattttgagagagggtttgtgttgtgygygtttygyggggtatgttgggagtagtagtattttagttgttttyggtygttggtygtagggttgygggattataattttygtatgaaatggaagagagggtggtgyggatagtttgaggaaggtayggatattttgagggaggtatggataygttgagggaggtayggataygttgagggaggttayggataygttaagggaggtatagtagyggtgygyg

SEQ ID NO: 10986 - DNA, 628 bp, Artificial Sequence
  Description of Artificial Sequence: Synthetic polynucleotide
tyggtattygtygtattatagyggatgggtgtatgygggyggtgattygagttygygygggttgyggaattttttatttattaaygtyggygtygttatgggtttagggggttgggtgaggtygtgagagtyggygaggaagtyggttttgygggttyggtygatttygggtttyggttttgggttgygagggattttagttttygtygtygtgtaaaatgtatataaggttygyggygtygtttttgygygtygtgaggatatagggttgtygttaaggttttaggaagggttttgtagaygtttgtgggggtgggatygyggttgatataaaagygtgtaagtgggttttattttttttattgttygtttttattyggtttygaaaagtggtttttgtttggygttttatttagtgtagygttggtaattatagtagtygtaatttaayggyggaygaagattggaygtyggaagtttygtttaygtygttaygggaaygtttttttgygtttttygtttatggtttggggtyggttttygttttttgtagtattgttttttgggtaatgtagtttgayggaattygggtggtatttggagygtattttttgttttyggtgaggyg

SEQ ID NO: 10987 - DNA, 215 bp, Artificial Sequence
  Description of Artificial Sequence: Synthetic polynucleotide
ayggagggaygggtygtgtagtgtagtyggyggggttagggttaggtygagggygygaggtggtagtyggttyggggaggyggaggttgagygagyggtggtgtttgtggagttgtyggttgyggtggaattatgaaaaatagtaggtatyggagtyggtttttagtttygattaggggagatgggatatgataggtgygattaataygtagtyg

SEQ ID NO: 10988 - DNA, 2638 bp, Artificial Sequence; identical to SEQ ID NO: 5981
  Description of Artificial Sequence: Synthetic polynucleotide

SEQ ID NO: 10989 - DNA, 2172 bp, Artificial Sequence
  Description of Artificial Sequence: Synthetic polynucleotide
aygggatgtyggtttyggtygtttttattaattgatttatgatyggtttggttagggygttyggtagygagagygtygtygygtygttgggaggtagygttagygyggggaagaayggyggttggtgatttagtatygygtttatggygaagttyggygttyggtgaggtaggaayggatggtaggttatgtttgttttaggaatgatyggattttttatggagaggtttatttattttaggyggggygttgggttttagtyggggataagttygtagttgttgtgttttgttgtttttttgttgttgtttaatagtagtatataatttaaaaggggggaaaaagtaaaataaaaaagaaagaaaaaagaaaaggaggtagaaattataattaatgtattttaaagggaggaggggaagtgttttttggagaatgggaggtygtttttaaagagggtaaggygaaaaattagtaaatatagtygygygggtgatygtttttgtgttttgygtttttaaaaagtygtttttgaaygtyggttttagaagygagaggagygagtagggtttygattygygttygagttttgtygttgagttygaaatagatattttagttttgygttttaggaatttttttttagtttttaggttttttgttgtaaatgtgaaaggtttttttagaagattttttatttttttttttttttttttttygttttttatttgttttttttttttttttttttgttggtggygtttgtagttgtgttagattyggttttaatagggagygagagagyggaaaaagttttttttttttaaaaaaaaaaaaatttgatttaaatttttttttattagygttattaaaatttgaattgtaaattggttttygttygtygtttttttttttttttttttgtttygagttttyggagggtgtttyggttttaatttaaattttgttgggtttttttttygtgttttttttttttttttgttttaaaaygtgagygaattygttttttaaatttgtgtttaggygygtagggtagggaggatttagagggggaaaaaatggaatagagggaaagagagggaggggagagagagagagagagagagagayggagtyggagagggagggagygagagaaagygagagtttttygttatttttygtygtttttagaatttatygggygtttgttyggyggttttagaaggtygggttgygttgtgggttgyggggagtyggaggttttttgattggttttttgaygttttyggattaattgtgttgttgtataggygtggtttttataggtygagtgttgggggatagagttgagttataaaaagaaggtgtyggaaattgtaaygtygtagygtygtatyggtattattgtttgttttgtgaatatgttaatatgattagagggygggygggagttattggggagygygygygtatagagtygtttttaggtggtttatygagagatygttgtagtttttgagttygttygttygttttggtttagtttaygtttgaaatgttttagttatttagtyggggattgagggaggaggtagggttaaggaggaagggggagggagagagggagggagttagygagtaggygagtygggyggggaaggyggagagygygttygggygtygggtaggggygttygttttttttgtatttygttygttttttygatygtygyggtyggttttttttttagttttttttttttttttygtttygggygagtygggygggtggtygagttttttygygagttgttattyggttattyggttttataaaagtyggyggtagtygagaagygagygtygagattttaggtttgygtgttttttagttttaygtggagttaagtttygttyggtygtygttgaagggttttygagttygggtgtttyggtgttggttttttttgygtttgggttgggggagtataaggatgyggttatattttagtataygtatgtgtgggttttttttttattgygttttattygtagttatgtgygggtatttaaatattttyggtgtatttgtattygaataygygttaatatattgggattgaaatatatatygaaaaataygtatatataaataygtatatagtttgygyg

SEQ ID NO: 10990 - DNA, 2548 bp, Artificial Sequence
  Description of Artificial Sequence: Synthetic polynucleotide
tygggtgggtttygaaggygaggatggttagaatatgtttttygtgatattttttgtttttttttagggtygtgyggygagaggygttygagtattgttaatgtgaygygggtttayggtygtatygtggggggtagygyggygtygttyggggtttggttttggttggtgaggttgtagttyggygggtagtttttgtgyggyggygttttggtagyggttttttgggtgtttayggtagygtattgttttgtagggtaagtaggatttttaggttttgtttagttggggttttyggygttgggtttygtatttgtygggttgttyggygggygaygygygggaaaggtggtttttgttgttttttggyggyggtyggtttygggtttttttattttaaggygtygygttygtttygttaggatgttagttyggagggggtggtayggtygggygagttygttttttttgggaygggattttttttyggttygtttttygtgtttttaggtggagaaagttyggtatgygggyggaggggtagggttttygaggggtttgyggggtgtgtttttgttttttttgygttttagttgtygttygattygtagygtttygaatgagtttttgtggattgtgaygttggtagaggggtttyggggggagtaagyggaggaggtgttagtgaatygtattttgttttattttaaggtgagaaggtagtttttaggtttttaaggttgggtatygtatttttattygtgtttttttgattttgygtygtttttttttttttagtttgattygyggattttttataaygatttggttttggtgtagttgtggaygtyggtgagttyggggggatyggygygtttygtgtgtttgttttaggagttttaggagttttttgtyggaatygtttgygttatygygggttggggygtttttttygaaggtattgggygtgggtgagtyggygygtggtgggaagaattgggggttygaggtaatagagtgtagggaggtygggttgttttggaaaaatgttgtttgtttttttaaagggggaggaattaaggggggtggtgggaaggggatttttaaggyggggtttttgttttttaaatttgagttttttattttttttttgtagaygggtttgaggttgaagtagtgagagaggttygtgtttttttgtttagtatygatatttgtygaagagttttggggttygggttgygttttagtattatgttttgygtygggtatttggyggggggygttgattygtgttaggtatgaatttagtttgatgagaaaaggtyggttgagtttttttagggttattayggttttttttttttttaygtttgtttgttattygatttttttgagtttttttgtttttatttttaaaatggatataagtggtaagtttatatttgttaggygtaaggtaggygttatagggggtaggtgaatgtagygtttttttttttggtttygtagggtgattygggaggttttttgatttgttttgagtttggttttygttttagagaggttttgttyggagttattttttggggggayggttgyggggagttagggaagttyggggtttatattygygtggtagtgtttaaggattggttttaggagtagatgagyggtgagygttttttttttaatgtttygtttttagtgttttaayggataatygtgggataagttygtttttattyggtttatgtttatttttagtttttttttgtttygggaaagtttgttttttttyggggaaggagtgagggggttagggttttaaatagagggtgagttgatttttgtttygttygtagtagttttttttagtygygagtttagttgtagggagtttttggtttgggattttttttaggagttgtaggtagaygtygttyggttttgygttttttatgttygtttgtgttyggggttttagggygtttgtgygygtttggygtattagtagtgtttgtagygtyggyggygatgyggttagttttgtttattyggattyggayggggggtagaggggagggggtttggttagtttttgatygtygtttygatttttgttyggttygtagagttgygttygttggygtataygttgttgggtttgttgyggaaygygtaggagttgttygggtttygttygggattgyggygtttggttttygttttggtttttttygttttagygtttagggagttttttttgtatttygttygggagttgyggttttatttaggtatttygygttttttagtttagtttagttttggttyggttttattygygyggtatagttatttttttygtygaggyggtattttaattttgtgtttttttaggatygygggttgtaggtattyggttttygaagyggaggtyggagtygygyggagaagttaayggtaatgaygttttttgtygatttttaggaggggataggttgagggtttggaygaggtyggaagygtttttattgtagtttyg

SEQ ID NO: 10991 - DNA, 919 bp, Artificial Sequence
  Description of Artificial Sequence: Synthetic polynucleotide
aygggagtygttgtagggttaggaygtaaagatttygaggttttttaggtygaggggaygtygttttygttttatttttgygttyggtaggtttttggtttygttagtatttgtygtttagggttggatttaygyggygggygggtgaggggtttttggygygyggttatygttygttttgtgttaggtgyggtgyggtagygggagygygyggagttygaattttgtaygtgtggtttygtygggtyggtygttgygagtttygtttyggtttyggttatygtyggggaggaygaygaygaygtggtgggggaygtgttggtattgttggtygygtttttggtttyggggtygygggygtygygygtggaggtygtttttttttgtygtttgygtygggaygygttggtggagyggygygygttgtaygagtttggygtttattatttggtgagtgtyggygygygggagggygggtgagttyggtygggygggagtyggggtgattattygtgtttttygtagttygaygtygagggtgtttttygtygyggttygggtttgaatttgattagyggttagtatagggygttygtggttggtttttaygttttygtygttaygttgtaygtgggtgaggttyggggygtgggaggatygttygttttgtygtttatttygtygttygttygtttgattaygttttattttttttygtagygttyggggagtygtygaggagggggtygtygygttttygggattatttgygtttgtttatttgtatttagtttyggtgttagygtaaygygtgagtgtatttyggttyggattttatattygtattygttyggtttttataagttggaggtggttaaataggtattggayggggttttygttygtttatattttatyg

SEQ ID NO: 10992 - DNA, 2488 bp, Artificial Sequence
  Description of Artificial Sequence: Synthetic polynucleotide
gygtagttyggtaggggyggtyggattygggtaaaygtagtttygggtgggagtagggttatttttgttttygagyggttggaataaaaatgyggattgtattttttttttttttttatttaaagtgtttagttttgaagataaggtggagggaggagagagagggyggaggtgtaaatttaatttaatttttgygygygttttygaggyggtyggttgttttygtttygtygtgtttttttattaaggaaggttttttygttaggggtygttaaygttygyggttttyggttagayggtgtatttgagagggatatttygttttttttygggagggattygggtttgttgaagtgggtttaattttgtaaatygygttttaatttttygygtygygtyggggaatttttttttgatatttaaygtttttygtttttatatttttaaatatagtttattttttttttygtggyggtygyggtaattygagttyggttttygtttygtygttagagaaygtttttttygtygggaygyggtgtygagttygttgtatatygagyggtygtggtataatatygyggygttgygygtataattatygttttttaggattygyggygygtatttygggagtggggtgygtttygygattttgggygtttagggttagatatattttttgggygtttygyggtttttatagtgtagtttttatygttttttttttattttygggtatatttattygtttttygttttagtttattyggtttagggygtagtygttttttygygtttttttttttagtttyggtaaaggaagttttttttgygtttttttttttagaatygtttttagtttttygtttttttaatygtagtttaayggtyggyggtagtagtyggagaaggggggyggyggttygggtttyggaaayggttygatygtygggattygggtyggatttygtatttgggttggaagygaggyggagatgggyggtygggattygygagtgagyggggygggyggyggtgatagttttatagttttagttgttgttgttgttgttgtygtygyggttgttyggggagaggggttggtattatygyggygygttattgttyggttygggggygggggtggttaggaggagggtttaggygagtagyggyggtagyggyggyggygtygyggttyggaggaagggggagggggtatygggtayggggaggygggagagggggygggatygggtayggggygggggygggggggaggggagygtagggagggygtaggtagggggagtaggaggagtagtaggaggaggtggyggaggggygggtgagagggaggagtgggtayggggggaaggggagagaggaaaaggaggtatttagggagaggggagaggagaaaggagggagagaggygyggggggagaagaggaggaaggagggggagttgggttaggtagggggggataagggygygttggaygygtygtygtgygtttyggtggggagygygtttttaagggggaagygtttygaggaagatttttgtayggggttgagttyggaaagaaggygttgggatttgtgtttatttatygttttyggaggttgyggtttttgggttyggtgggggttggggggagagggtattyggygggttgtttgyggttaggttaggagagggagatttggtttaaataaagtgatttaggtatttttaggaattttyggygttyggggttttttygggtagttttygatttttatgygtttttygggtttttagggaygygggtatttgtggggyggggttgtygggtttyggggttyggttttttygggyggtyggagygagatttygggttgggaaagttaggtaygtggtyggttttyggtygtattttygttttatttttayggtagggtttttagtgtttgattaagtttaagttygagtttttyggygygttgtttatyggttgttttttygygttttttttttttttttattygtatygtttygttttttattttttttttgttttttttttattatttagtttatatttttttygttttttttttygttttttgygggtattygagtgttygggaggygtttatttgttygatttaaatatttaygygatttttagygttygtygttygygtgttygttttygtttygtygtyggttattgtgtttygttagtttatatygggtygggttttgayggygygygagttatagttgtaaagtaataggataatttyggggaygtygttttagtttagattygggtaygtattgttygtggagayggtatygtyggggaggggagttaygyggattttagatgyggttttttaggyggatagatttttgttyggggygtaggaggaggtaggattggtatygyggggtgggagttttggattttygagtaatttyggattyggttyg

SEQ ID NO: 10993 - DNA, 513 bp, Artificial Sequence
  Description of Artificial Sequence: Synthetic polynucleotide
aygttgttayggtaaygattgtaygygtatttttggagggtggtttgyggttttataggtttygygttyggggaggagaggaggtggtygattagatygtgggttttygggtttttyggtttttttaggttttaaattttttttattagagattttgtttggagtttttatgttagygtttttttttatyggtttttttttttaygtyggttttagtgtattaygyggttyggygagggattgggaaygggatagggaygygttttaatttatttagyggtggagttggggggyggygyggttaygtgggatggygggtagtttaggggattygggygayggggtttggygggtagggttgttttagtygtttttataaagtyggttttttygatttttttttttttttgtagtttttttttttttttttgggggttgggaggggayggggygggaygttggtagtygggagagtggaaaaggttgtatagagtttygtgataagttyggtyg

SEQ ID NO: 10994 - DNA, 1766 bp, Artificial Sequence
  Description of Artificial Sequence: Synthetic polynucleotide
gyggatggtyggtttaggygygtttttttattyggggtygtttgtgttyggtgtgtygtgttygygggttaggggygyggygggaagttttygttygttygttagttagyggggttaaataggttatttttttgyggayggtyggygtyggagtttttttttygttygttyggatttattttygtaagtagygttggggttggagtygggyggttyggattagtttyggtttatttgggyggygttygyggtygggtttaygtyggggaaggtttyggtygtygygagttttygttygagtttygygttttttagttatttatttgttttttaygttttatttattagygygtayggtttyggtaattttattyggagyggggygtygtygtygtttttgtygtagttyggtygggtygttgggygtaggggatttygygtygtygttgtygttgtygtygtygtygtygtygttgtygttgttgtatttttyggygagygttgttgtttttttttttgtttttttttygttttttaaygtygtygttatygttttyggtttttttttygygygtygttttagttaaagttyggtttygtatttygttyggatygtttttaaatygttttagttyggtyggttaygttgttttagttagttttttggtayggygttatygtttttygttygtttgttygtyggtttttaygtaggggaggygggygygtttyggggyggggagygtygggtygggagtygyggayggttggggttyggggygyggggggtttagtygyggtgtttttttygagtttttygygygttagygtttttattttyggtttgggggaygygyggttygygattyggttttgtttgttttyggygtayggtttyggtttyggtttygaagtttagtttyggayggggtagtgaaygtagagttggggtttyggyggttttygatttttygatgttttyggattyggttggtygygttttyggygtygagygygtattttygtygggatatatagaygtatatttattygatatattttygtttttgttygttttyggyggagagttgaaatagatgtgggattygtttaggagttggaaaygagggagggaagygagttagagttttgtgtgtaygtgtgtgtgygtaatatataaattagggggtatygttaataaattaaatatygtgataaatttaggagggttatygattaggtttatttggttggaaaygaygtgaatttgtttttttttygtttttttttttttttttttyggagttggagggagttaaatgtttygyggggagtgygatagtttyggtygggygtttttttygtaatgataygttaataaatgtttttttttatttgtttttataggattygtttyggtttgtaaatattygattgtttttgtygaaagtttygygttygtttttagttatatatatttgttattggagaggtyggygtyggtygygattygtagtttaatygtagggtaaatygagttgtttgtgygygttygagaatttttygagaaattaatttyggtttaagtgaaaatagtagttgttgtttagaaatggttygggagtagtatagaaaggagaaatyggtttttttygaaaggggaggaattggatttaagggggtgttgtttatygtggttttygttgtttttygygttatagaagaggtyggagggggatyggtttgaygygggtgggtaaagagyg

SEQ ID NO: 10995 - DNA, 6511 bp, Artificial Sequence
  Description of Artificial Sequence: Synthetic polynucleotide
gygatttygggggttagtagagaggagaggttgygggaggattygttgygaagggygaggggtggygttgggtgggaygggygtttggggtygtgtagggtggtttttgggtgttgttygggttgtttgtygtttagtattggygtaggaagaygggttygygtagygtttggtaatagtggtttgttttaygtttggaggygattaagttttgagttaaaggygtygggtttagtygggaagtgtatggygatttagaatayggagyggagaaggttttaggggataygaggttatygttttagttttygggtttgygtttygagyggttagggtgygtayggatgggtttygggatgttagtggagaggtgataggagtttattattttayggttaagygtgtgaggttttyggygggygggggtttttttyggggtagggtagggggagagttaggtatgtttttaaygggttttttagtagaatygttaggaaagtggtttttaattttaggtatttttgtggtttttaggtagttgggygattaaaaatttatttttgtttgttgtgaaatgggataggtggttgttaggttagagattgtgtttaygaagtttygtttggygggtygggattgaygtggattygggtttttttyggaagtttgggaatttgtgagttttttagtttttygttttattttgtttgtttgaaaaaaggagttgtttgagaggaagagttaaggtttaaaaggttttaaaygaagagtatgyggtttgaygyggagygtaaagaagygagtagtgaattgaatttggtgggattgagattagaggygtttgtatgyggyggtygtttygygttttattaaagtaatttgttatttaygataattatttttgtaattattttggagtggttgtgatttgatgtttgtggtgttttagggtatgtttttattggatatagatattttagggtgttttttgaygttagtgtyggtttagtgggtgttagtgtygygaagggagggtggygggygtgaatgttttttttttttgggtttgtygtaggtttyggtttttttattttgtttgattttggygggtttgttatttattgaggtttttatyggygtttaygttgtttygagaggygggataaaygttyggygygtggygyggagtttgygaaagygttygggggtttttattttttgttygggagttttttttttggggygggaagaggagtygtagatttgttygaattttgttttattygtttggtygttttttttygtttggggtgggggtaggggtggyggatgatttaggtttggggtygggagttttgtttttaaaggtattatttygygtttttttggaagtggygygttgttggggygttttygttgttgtagaggtttggtttgyggttttataggggygtgggtttagggtttttagggagtaagtgagtttaggttttttagggggyggtagaggggaattttygataattttttatttttttttttaggyggttgygaggttttyggggttttagaggggtttttttttgtyggtgtyggttgttttgagygyggttaygtagttygygtttttaygtgggtaaggggyggggaygttggagggaggttgttttggatgttggagttttyggttttyggttttgttgagtagaaaagttgaagttaaggaagggttgaggtttttttataagggygygygygtgtttgggtgtyggtttagaagtygagaatgtgygtattggggaagggtttttygtgtygagaagatagaggatttgttttagttgtttttygtatagagggygyggaggttgygttttagttygaaygtttatttattggaaagagggtagygtyggggtttagggaagttttttgggaatgaatggtttttgttaagyggtttyggattttttgggttttttgggtttayggtayggtgttgygygagtttttagtgtttatyggtttttttygttttttgygtagaygtttttaggyggggaggtatatyggttttttygggtagttttggttagtgttgttgtgggaaaggagagttagggtttgggatgggggatgagtatttttttgtttatttygggttttagygtgtaggaggtaaatttgttagtatagataagatagtttgtttaagttgtattttaggtygggttagagaataaaatygagggttagaaggtttagaatgtyggatagtttagyggtattygttagggagttttaggygttygaaagaggygtygtatttttggygagtttaggatttatttttttggatttgtgttttggagtgtttgygggtttgggtttaatttttgtttttggtaggtgtttttttttttygtygttaatattaggagygttgtttttgyggtaatttattttatttttagaagtttgttttgggatygaagtgttagggttttgtgtgtttttttatgtattgttttttttagtgtaaagttttgtagatatgtttggtygaaaagttttagtggttttaatttttagattttgttttygygttyggtyggaaaattatttgggatttggttgttgtttaaggtygggggaaagttttttttggaggaygtttattattattatttttttttaggtttatttgggtttaaataaatgttaaagtttaaaygaattygagaaggaatagygaggtagtggatgtygttatttygtggatgggagagttatgtttattgtaggtgyggatatygtattgataggtattgattattgtaaaatygtatttagtattaaatagaaatagttttgttttttaatttttatagaatgtttaaatttagtttagggagttagttggggygttttaataaataygttttygagaattagygatgttttttttataatgaaagttaattgttgtataataattgggttaaagaatttygttagtttaaattttaaaaattagtattgtattttgtttttaagtttgggtggtaagtatygaaggggagagggaagtagygtttgtgtggaaggaagtttygttttttgtttaaatatgtgggatttgggtgtttatttttttagtygagagttttttgtaggtttttttttaattttttgtatttttttatttttattttattygtggygttygggttttatttttgttyggygttttttttttagggygagtagaggtttttgagtgatyggttygttagaggtagttgtagagtyggygtttygtagggtagggtagggtygggtygttgggttggtttagtgygygygggttttttttggttttagttagtygygggagatgttatttygggygatagyggygagaygtygttgttygtaatttttgggygggtaggatygtttgttgtttttgyggtttttggggtagattttttaggagttttttttttttttttttygttygggggtygggatygygttgtgtttayggagggaattgggygtttttggygtattggggttttagttgtatgattttagtttagattttaagttttagtggggtgtaggtgggatgggatgtgtttttaggagatgaggagatttyggttgttgagtygttttttaaatgygtagttttttaattttaggtgatattygttttttggaggaaygagtgaaggtygtttaggygaaagaggggtgggttttagtatttggatttttttttttagttttgttaattttaggtgtgtttayggtggaggtgatagaaggaaggygygtygggggatttaggtttygtaggttttyggttgttaaygaggtatygtttattgatttygygtttygttttttatagygtggggttyggygttgygttaggttygggtgyggggyggagttaggttgggattggttgggggtygtttygttyggygtttgggttttygygtyggttttyggggaggagttatgataattttttttttattaaggygttygggtttttyggttatygttaggatatattgttygggygyggtttttttygttygyggagyggttttgatattygyggyggtagtatttaygttygtagagtygtygatgygtgtttagtgattyggatagtaaggttygygygyggygggggyggyggtagaygtttggttatygtgatttygattttggatttatygtttgggggttggggggattttggatttaattggygattgttttgggggaygtyggaygttatgttgtggaaaataatygataatgttaagtaygaagaggattgygaggtgagttggggtttyggggtgtagtttygtttygtygaggatagttygggaggtaggggttattggatygaggtyggggaygagggtataggagttttggtttttyggtgggaygggatttattttttyggatattttttagtttatttttgyggggttttttttttgtatagggtttttttttaaatagttttttttygggaaygaggtttggaaagagaatggtaaattttatttatatagtttatygggygtttttttaagyggtaaatagttttgtttttygttttttyggaaaagtgtttygtttgtaatttttagaygtggtttttaygtaygaagtttttgtttaaaggggttagatgaggttatttgttagygatattttggyggatatttttttaaggtyggtttgttatttgtttygttattttttyggggaagtaygaaaataatygaagtttggtttttaaaagaagtgggggttggggagtggtggtgggggtgttygaggttagatggggtygtaagagttygygagtgttttagtttgtyggataggttgagttagagtttyggagagtgggagggaagaaggaggyggygagygggaagaggaagaagaygtaggtagygttaggygagtttaggggygtygggagygyggagttygggttayggattygygggagtttattgygttttygggttttggagggttgtttttgttygtaggttygggygttttygttaggaggygatagygttatgtttttttaggttttyggygtttygagatttttgggtagatggggaygtattttttagaaattgagtygggtygtttaggggygagggaaygtgygygggtaaggttgtttaatttttagggttttttatgttttttttgygtttygaygtgygagaatattgtttttggtagtgtagggygtttttatttattatttttttyggttgggttyggttagtagggagggtygttttgtgygygygttttttttttattttttagggyggygtagggtggygggttttgtttttygagygtygttygttyggaggtttttgtttygagggygtggaagggagggtttygggggygggggaggtgygtatttttygygtygygtattttattygygtttgtygygttgttatttttagtagtttttgygttatgggygggttttaygagatagttttgtatygggygttyggttttttygtttygggttttggttttttygtttygggtttyggttayggatttttttggtttaagatttagggttyggatttggygtttttaagygtttygggtttgggagtagygtttagattttygtygtygggttttgagaattygtttttttaggttttttattagattttttttttttttygtattttttgtttataaygaaattttyggggygtattgttttygggtatttttygattttgggtaagtttygtygggyggggtgyggttggtttttyggggttttttgygtagttyggygatgtyggttagttygtagtagyggggtttygtattaayggggttttttgtttttttttttttttttaggatygttaygaygggagtagtaatgggaattygygggttttttatttttttttygtygggtagtatttttatagtttygygttattttttttttatattggagtygtygaatattagtygttattttattttttttttttttattagtagttggtttatttttagtyggtygatttttattygtatttgggggaagygtaygtygtygttattaattttttgtattagtyggygtttataggtagttagtagtaggtttggttyggtygttagagttaggagggagyggggttgttttygtattaygggygttyggtyggtttattgttttattttttygggttggaggygggygyggtgagygttygtagggatgtttatygtygtttygatttgttgttgttttaygtataygttttggatgtygygggtttggtygagaatttggggttttaygatatgttttattagatggaygaggtgtaggtgagyggygttgyggtttttgatyggatttgtttattttayg

SEQ ID NO: 10996 - DNA, 6511 bp, Artificial Sequence; identical to SEQ ID NO: 10995
  Description of Artificial Sequence: Synthetic polynucleotide

SEQ ID NO: 10997 - DNA, 338 bp, Artificial Sequence
  Description of Artificial Sequence: Synthetic polynucleotide
tygtttttygygtatgygtttaggtyggttygtaggtttttttygttttagtyggtagttagttygttygygttggggttatygygagtyggttygtagyggggttatygygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtygyggattggaggttttyg

SEQ ID NO: 10998 - DNA, 936 bp, Artificial Sequence
  Description of Artificial Sequence: Synthetic polynucleotide
gygttttgttygtttattgggtttttygtyggtttatttgtatggttygaggggggyggggttgaygtygygttgggaatgttttggtygagatattgaggtagggtagagagygtttgygggygtygggyggagttgttgyggattaggattygagtygattttygatttygatttagattttaattygygttttygtttygtygtygtygttatgtaygaygtagagygyggttggagtttgtttttygygggttgyggttttttgggtttttattaygtyggggygattygttgtttgagygagtaygtttygtatttttttygygaygygygtatgttgttyggygtttyggtyggggygttgtattgygtyggygtttttttyggtatttygttgggtgygtttggggaygttgttygggttttaygtgyggagtgggtgttttttaggtyggggagygggggatttttaggggtygyggggttttggaggagygggtatyggaygyggatayggyggggtgtatttygagggtttttttygaggtagatgttttttgygggggygttgtttttgggttygggaagggggygttggaatttygagyggttygggtygaagtttgggattttygtgygtttttatttttatttttattaggygttygtgtatgaagggagatttttattttyggattgagagtyggagygtttyggagygayggggagtagggagygggattyggggyggagggtagtgttggtttttgyggatttygggttttttgtgttttttygggaggggttggaygggttgagttgtygaggggtygatttgttttgggtyggataaagagtggggttttggtyggttttttayggtgggttttttttttttggggattgagggatttaagatatttygygtttgyg

SEQ ID NO: 10999 - DNA, 2184 bp, Artificial Sequence
  Description of Artificial Sequence: Synthetic polynucleotide
gygygtttttttaatttttttgygttttagttttttyggttttagtattttygtgatttgagtatyggygggtttttgtttattgtttagtattygaygtatttgttttygtygygtagtttttttttttyggtttgagtttttttttyggygygtattgtttttgtgatttttttttttttyggttatagatgtagttttyggttagaagttttattttttygaggttttygtttttgttaggtagtttttttgyggygtygtttatttagagttttttttttggaygtttttttagtgtttttttagtagtttyggyggttttttttttatttttagtttttttttyggttttttaggaaggggttagattttagtttagtatttagygttttttggttttttttttttgggygttttttygatagttttttttagggaagttggttygttgygygtttttattttyggtygtygtttggatagaggygygtaattyggagggygtaggtttyggttyggagaagggggtgtygtyggygtttygattttttaggaatggggaaatagaggtayggtggattyggyggyggggttgggtttggggttggaygttgatttaggatttygtttttgttygttttgygtygygtttttttygggtyggttttgatygagtagttttaygygggttyggggttygtttattygataggagyggggggttgtagtttaygagtttaygagttygtagygaygtattyggagtgtaatttygtagagttayggagatattttttyggtgtgggygtttygtygygtttttttttygygggttgyggttattttagggtaggatagagtygagatgttygggtgggagygatgttygygtgggggygatgtaaygggggagatgtttggggggagggtggtaaggtgaaatttggtggagaataatgggggtgggtgggygatttttggggaggtgttyggtgtggggtgtttttggttygttyggggatagtgygygttttttygttygyggygttygttttgttygttttatygaggtttttygggagygtttgggtttayggtttyggggggttttttygagatttgggygttgttttgggggagtaggggttygggttattaaggttygtgyggatygtggggtgttttaygtttaggtygggggattttagagtttygttttttttaagggygtygygtttyggattgtaggtggagayggggatyggtttygyggggtygtygataggygyggggygggatagggtgggaggyggyggggygtagagtttttyggtygtyggygygattygggtatttttttggaggyggygggagygyggtygyggygttttyggggtggggtttaggttggaggtttyggggygtatygttttagttttatttyggtygggttttygygttgtttttgyggagagggaggaaggaaggaaggtagggagggaggggayggtyggtaggygtggggttygyggygttagggtttttttttttygttygttttattttgtaattygtagttygggyggggtttygttgtttttttttygaatatagtygtttttttttttttttttaatttygagygttttttttttygaatgygggagtttatagtgtaygggaagtttttttttttttttatygaggttgttygaygttttttttatttttygatttttygtaattattttttaaatgtttyggyggttagtagggttggggtgggygtaggagaattaggggttttgttygtatgtaggggtttggggtyggtgtggtygaatgaaygygygggtttagaygagtttgtgatgttttygttttttattttttygygatttggttttagaagatagtttgagaggtyggtggtygyggattttggaygygttttttttttgtttgtggtttttttttatttyggtagygttgtgagtttattttttatttataggagttatatttagaatttttttttggggttatagygtgggttttygatatttgtgtgattttagttttgtttttttagggttgygtggtgaagtttttaggatttttygygtgggttgggygggtgaygtggatgagggataaygtggtgaggttttygtygtggyg

SEQ ID NO: 11000 - DNA, 413 bp, Artificial Sequence
  Description of Artificial Sequence: Synthetic polynucleotide
tyggggygtgggagttgygttygtttttttttttyggygtttygtggagatygggaggtttagygttttttttagtttttagygtygtttttttagattttagagaygtyggttagggygyggygtttygggttattgygggtttttttygggygggygaygtggggggygaggtatygygyggyggygtttggygggtattgttgttygyggagggayggtgggggggttttagtagttggygggggtggagggggygggagagggagtttgygtygggttgagtttggaggtgyggggygggttyggggagygtttttggggttttttttgttatagtyggggyggttggaattttttttttttttttttttatttttttattttttttgttyggtttygtygttaggtyg

SEQ ID NO: 11001 - DNA, 403 bp, Artificial Sequence
  Description of Artificial Sequence: Synthetic polynucleotide
tygtttagtttttgygttyggaagaaaatttagygtaggtygggtttyggygygyggaagttttgygaattttaaatgtgtgygttgagtygaggtttttaagyggtaggagagaatttgattttygatattttttttaagataygygtyggtggatygggttttgggattggtttattttygggttggattttggggttygtatatttgaaagygtaaatttgaggaatgayggyggggtgatgggtattttatagagtgggatttaatygtgtttagtaatagatttttttaaatttttttttaaaaagagttttttagagttgtygaaattttygyggggtgaaagttaaatttttggagtygttgtgtagtygggtagaggatayggyggygygagtyg

SEQ ID NO: 11002 - DNA, 675 bp, Artificial Sequence
  Description of Artificial Sequence: Synthetic polynucleotide
tygtttttaaaygtaygattatttttttagttttttagtattaaatttagyggttttattyggttaygtttttaygttaggttatgatttttatatggtttattgygtaagtttatatttagttttaggaagygagttttaygtygttttagttttgtatttatagtygttaagyggtttyggaagtygaatgtyggataggttaaagatagygtygttgtttyggtattgtygttagagggygyggagtygtygtgttggtttgtattttttttgttaygttagtygaayggttayggtaatggaggattttgtygtatgygaygataggatgattgttttttttgaagttttattaaatayggagaggtttttttgtttttgggagaygyggtgatgtgaygtagyggttgtagygaaggttttttgtaaaagatggtygttgyggagttgttaggtgttttttggtaggyggyggtygtattataagatggyggttygttttagggttttataygyggggttgyggaggyggyggtttygagggttttygttttttgttggttttgttttygygtgyggggttgygatttgtttttgtgtgygggtggaagtgygggtygttttggggtygagttgtaatttygygatattttattggagtgygatgagayg

SEQ ID NO: 11003 - DNA, 580 bp, Artificial Sequence
  Description of Artificial Sequence: Synthetic polynucleotide
gyggtggtygaggaygttttttttggygttygggggtatyggatygyggttygtygggatggaggtaggtaggtagygtttygggagggttttagggagyggttyggagttgttyggyggggygtttagggygtagygggtagygtttatygagggygygtaggtatttttygaaattttygttgattaatattttttagtatttagtgaagtygattggtatttyggggagtgattggagttagttggttataagygggygggayggttggagattgtygggatagyggttgtyggtgttaygygggtggtgggyggttyggaaatgagygtttttyggggatagggggttttgyggggyggygatagttggatttttagygygtataaagtttgygggaggatttattgtagyggtygttttttttygtttagygagggygggygtaggggygggggatgtygaagggttaggtttgtttaggtygygttattttygttttagaygtttagttygttttttttataaaggaagaggagatyggagaygggaygtttgttttgttggtygaatttttyg

SEQ ID NO: 11004 - DNA, 858 bp, Artificial Sequence
  Description of Artificial Sequence: Synthetic polynucleotide
tygggtaygttgagtttatygagaattttaaggagttaaygagggygggtgtttttatatttttttagggattagygtygttygatygtaattttggggaagatttyggyggttttggagaggagggataggtttttattatttatttggttagtttygyggaagggttggtggatgaatgaattgttttttygtyggtygagtttygygggatagyggyggatygyggggtgtttatttgtggggatgttygagggttttttygagttygtatttagatagggattttaggggtggaggaygagygttaggagtagtagttgaggttttatygtgtatttttttatattyggttttygagggtygygygggtttaggygtttayggtttygtagygtygygtttttygygagaaygtagagattygggttygttttgagtygtygattgygggygggagtyggygggtaaggygygyggtyggtagtyggagyggygygtaaygtagttgagtgaggtygtyggtggaggtayggagtagtaggygttyggggygttgyggaggttttataggtttttygaggggaggygayggggygggtygygttttggttattggtygtyggttgattygtygtygttgygygttyggtgyggtygttttagttygtttttttgggttttaygtttggattgtttgtttagygyggaygttatttaaggagttgtttgyggttaygtgtggaggtttaygtagygtttttggttggaayggggaagtttgtatttagttttgggagtgggtttgggagagggaggaggagtygtygggagtttggygggagggyggtgttttyg

SEQ ID NO: 11005 - DNA, 5715 bp, Artificial Sequence
  Description of Artificial Sequence: Synthetic polynucleotide
tygggattyggtttttygtattygtygtyggtgttgtygaygtttatagygttgatgagattttygaggtttygggttyggttttaggagtttttgtttttyggttgaggaagyggyggyggyggyggttgyggttggggtggtagttygggttttttttttaygtygatggygatgtagttgagattattttggaagtyggtagaggtttttttgygtatgggygatttatygtttttaggataatygattaagttttygggttgattyggggtttayggtyggttttgyggtgttaaagggggygtyggttgtaattgtygtggggaggtgggyggttygtygttttttttagggtygatatttaygtygttttygttgttttttttgagagagatattttttayggaggtygagttgtggygtttggggttgtgggygaaggayggggataygggggtgatygtygtggtggaggagaaggtttyggaattgtggyggyggyggtttttttgygggtttgygyggatgattttggygtygyggtgggggttygggggttggttggtttgtaggaaggtttygattttygatatttgttttatgaggtttagtttttttaygttygaygtygggttggttaygygggtagtttttggtttygggggggtygygataggttgyggyggggtggyggttatattaaaagttatttyggtgtagttattattgttttyggtgttygaggataaygatgaggyggygttygggttttgggyggtggtaayggtygaggyggggggtaggyggtatagttttttyggggtyggyggyggtggyggyggttgtagagaygaygayggggaygyggayggaygygggggtaayggyggatayggggaggaggtttygggggataggaggtygtttaaggagtttayggggtggtygttyggggygttyggtttaggagatttgggggagttgaagtygaggtttatgtagtyggagagyggagatygttgtyggttgtygttgttggtgttyggggtgtttgagtttagygaygaggtygggttgttggyggataagagygaggaggaygaggtygtygaygttagtaggggaggygygggyggygataggygggtttygggttygttaaagtygatgttgatgtattygtyggggtttttgggtttyggtggtagtgggtattygtgtatgttgggtaggttgggtagtttttttagggataggygygtgggttttatygttyggtygygttggtttaagaagtttttygggyggtygtygttaggtygtaygggygaaggtattatagggtgagggggttgygtggggtyggtttygaaggygttggtygtttggttgggttttggygtggtttgaggttttagaygttttttttttaggatgygttttaygggggagtttatgagtaygtattggtygttgttttygttataggtgtagggggttttgtaggagyggggtaaggagttgtagtagtagtygggaaygtttttgagyggtttttygtyggggtgtagggttgyggagaagaagtygggyggggtgttygtggtgatygygtygttgggggataygttgaggtagttttygttgggtagtagtttgttatttgtatgttttatggatagtttggaatygtattatatgygtatgtatttattgttttygggggagttttyggygggygagttggttttgtagtygttttygttygtygggaatgttttgttygtygtagaggtgggtgttggtttygtaggtttygtagaaggtayggyggyggyggyggyggyggyggttttgggttgtaagatttgtttgggggyggataygttggyggggtttatgggtatgtagtygtygtttttgtagttgtygtttttattgttygygagggtygygtygggygttatgggtatgtagtygtygtttgtttttaggttgttgttggagtttttgtgggagtygatttygatgttttygtagttttttgggtaggggtggtaggttattttgggagaggaygyggggtaggaygggtagaggyggttygygttgttygagaaggtggttygtattagggtgtatttatttagygaggtagaggagggttggggtatyggtygttgtygggttggygtggttagggagtaggtttttttgygtagttttyggtttaggttttgggtygygtttttygagattyggyggtaggagyggttatagtggtttaggggtttgtttatggttatgtattygtagaatttatygtygtygtygtygtttygggtygggggygttttygygatggattygggygtgttgtttyggtggttgtagaaggygygtaggtygtttgggttggagtygtattygtttagggatatgaagtyggggtygttgggggagttygaggyggaggygttgtygttggagggtygttggtyggggtygtggtgtagyggatgyggtagaggygggtgygggtygggyggyggygggtaggagttygagtygtggtygttgttggaygatagggagtyggggttggtggyggygggyggygagtgygttaygggtatggatatggagyggttgtgttgtagygygttttttgtyggtagtagygttattttgttttygyggtygtygtagtygtygtttagggtgtgygagyggtttaggggygygygtatyggttyggggtttagggggtttttagttatygatatyggtttggygttygyggtygtygttttygtygtygygtygtygtygttttygttggyggtgygtattyggtaygagttgtatttggtygtyggyggggtggyggttaggttgtyggtgygygagyggygtattaggttygtttggttggggggtaggttgattaggtggtggtggyggygygygtyggggaygttgatggggtgygtggtygaygatttygaygattggtttttattgygyggtyggaattygaagagttttttgagygtttttatggtttttaggatggtttygtggatgttttgygttattatygagtygttygtttgtatttatagttygtyggggtttgtgayggtygagyggtttatttygatgaagaagaagttgttygagtggtygtagyggyggatgtttatgagttgtagygttatygayggttgttygtagttgagttttaygaagtygatggtgygygtagataggtatagayggtatattttygttaggtttttgttttggtttagatttttgggttttaggtttatttgttatattttayggtaggyggtygtggygggagttattagttygtagttgttttyggtttyggyggygtyggtagagtygtttagggygtygggtagggaggygttgtaggaygyggygggygyggyggyggggggygygttttyggyggtygygyggttttygttgattaggtyggtgagygygyggtattagtttttttgtttttgttygttttyggyggttayggygaagtattygtttttggtgtagagggygattaggtatttgtgtttggygtyggygygtttgttgatgtttaggtagtagtygagagygattattygtttyggygygtttgttttgtttygttattttttttygttttygtagtattygagtygyggyggttgyggygtygatttttygttygtygtygtttygtygtygttygygtygggttygygtagtaygaagaagygtttgtggttatgtttttgtttgygtaggtagtygtatttgygtaygttgtggttgttgttgttgttgttgttgttgaggttggggtygttttygttygtyggttygggyggttygtgtygyggygggttygttatygygggygttttaggtygygyggttygggttyggygtttaggggttggggygaggggyggagggggygygggygggggyggtttttttttatttttgygttyggtygttygttygattaygygtttttygggtttaggyggtggggaaggttyggggaggttygygggggttagtatygttyggyggygtygygtttttygygttttggggtttttgaggatgttyggygygggyggtggtygttttttttttyggttgtttgyggtygttgttttttygggttttygggyggygtygggggaygygttygttgggtygggagtyggggttttygagtygyggggtygagtttaaggygygygyggtygtatyggggttgttgtygtygygtygygtttygggaagtyggggtgygttygggygttyggggttygygtygtygtyggggttgttgttgttgttggtgttgttgttgttgttgttaayggygattygggttygtygyggttttygtygtatagtgagtaatatatygygtatygagtgattgaattaagaagagtaaaataatatgtgattyggygttaygtaggtatatatagygyggtygtttygtttygttgtttygtattggygtygygtttttygayggayggygygttyggttaatyggygyggygttygygggggygggtygygygttttygtttygttttttttttttttygggtygygtttttygtygttttttttttttttygygaaggtttyggttyggtygggyggggtggggyggtttyggttttattaattagyggtttgttgtggatgtyggyggaggagatgttatttagggygggaaaaggggygyggaagaggggyggggygggttayggygygtagggtttttttttttygtttyggatttaattaattgggtttgagtttttgtyggggagggggygtygggyggggtygyggttgggyggggygggggatygggatyggyggygggggttgyggttttgtagtggaagtatgggyggygagtygggtygtgttttyggggygyggggtttttattttgggygagggyggtygttttygygttyggggtgggygygttttattttygtttttygtttttygttttygtttttyggtygtattttygttttttygtagtygygaaaygyggggaggttttagggttygyggtygygggttygygagtatygygttttagatygagagyggygygygttttttygtggaggatagaggggygyggagggggygtttgtgttttattygttygygggygttttayggggygttttttgygttatttatttgttagtttgtygggaagttgaaatygygtttgggaggtaataggagaaagagatyggggayggtaggyggagaaagtgyggtttttatagygtyggggagagggyggattygygagttagyggtttttgagtygggagatygygygggygtttttttagttttygtaggagygtygtttttttttygtaggggygttttttttttttatygttgtaggagtattttttttttttttyggaagygtttttttattatatygttttaagagtttttttttttttttataggggygtttttttttttttygaggtaggagygttttttttttttttataggagygttttttttattttaggagygttttgygtttagtagaygggtaggtgggygggygtttattatttgtgtgygyggtgygggyg

SEQ ID NO: 11006 - DNA, 858 bp, Artificial Sequence; identical to SEQ ID NO: 11004
  Description of Artificial Sequence: Synthetic polynucleotide

SEQ ID NO: 11007 - DNA, 247 bp, Artificial Sequence
  Description of Artificial Sequence: Synthetic polynucleotide
tyggaattttyggggaggattaaygtyggygtatygtgyggtyggggyggggygtygtttaaatttaggttttgtgatagygattgtggyggtttggaaagygtgggtttyggttattgggtaygagyggttaygtgatagygggtttttttaggttagygttggtggttgagtgatgtaattaygtggggtttgaagttttygtgggtgtaggttttttygttatgttgaygataggtagtgttyg

SEQ ID NO: 11008 - DNA, 224 bp, Artificial Sequence
  Description of Artificial Sequence: Synthetic polynucleotide
aygttygtttttttttygggtagttttttttatttaggygggatttgggttttygttggatttagggtygttttttygtaggyggggtyggttyggygygtattttgtttyggatgttttggygtayggtttygygtttygtttttattttggygtatttggttttgygtttttttttygtttggygtagygttttttgtygtttttttttttttttggyggyg

SEQ ID NO: 11009 - DNA, 1174 bp, Artificial Sequence
  Description of Artificial Sequence: Synthetic polynucleotide
gyggygaattaaagagtagggaattataaaagayggtyggyggygagtaggttggggtgayggggatttygtggataaygggtttgaggaygtttagggttttagttttttttaggygtttttygtyggggtaaygtagagtagttgtygtttttttygygttttagtagatggtggtgttagttyggtttygtgttyggtygtygttgygttygygtttttttttttygtagatggtttaattagggttttygttygttttttygyggttttygtttygygygtttgggygagygttgygaaygtggagttaggtagttaagtgttattgygtatagtaggtagtttggtaattgagagtataatatygagtagatggtgttygtayggygtgatggatattatataygatagtttgagataatttaggaattttttggtgattygaggttttttttgtataaaatgagttttttttttattgtygtgtatttttggggttatttgtttttttttttygattgatattgaattggttttttattatygattttttttttagtyggaggggaggaagaatttaagtgggggagggygygggaaggggaygtggagggaaayggaagggttgggagtggggtaggggggtagtggygattttyggggggggagggtggyggatattagattttagggtygatagttygggagggatygggttttaggattttagttgtataaagtyggttyggggagggggygataaggagygagtttygggtyggttyggtatygttgtttyggtttagagtttttgtaatygtttggtttaygaataatttaaatgaaatttagggttttattgaaaaagttttttggggtttaatttagtttttygattttagtttatatgtttataagtttttaggggatttyggttaggaagttaggagtggggttygtgygttttyggtaggatttagattgtttttyggygtaggyggttttaataaagaagtttaygaggyggtttygggygygggtaggggyggtgyggyggygttygggagattygygaggggttttggaggttttyggttygygygygtygttygggagttygygaggttgyggtgtgttttagygggygtattttttaggtttygttatatyg

SEQ ID NO: 11010 - DNA, 8657 bp, Artificial Sequence
  Description of Artificial Sequence: Synthetic polynucleotide
tyggattttttttygggtttttygggygtttygttttttyggggttggtttttttttttttttygggygtygtyggtygygggtygtttattttttttgggttygtagtygtygttyggggatyggtagtgggattygagygggtgygygttygttttgttygygtygttggtygtttttggygyggtgtgtagggtttygtygggggtygyggtygtagagttgtatygtaggagattttggttttgtagygtygygtttaagttttygtagtttgtgtagttgtygtagaagggygaygtgtagtagagggggyggtttagtagyggygaggtagggtagggygagttttttggyggtgtttyggttgaggtyggygyggyggtygygggtagtttyggtggttygtagttygggtttaggttyggttgtttgaggttygaygtggygatttyggttagygattatagtttgggtttgttggyggggggyggygygttyggagaygttyggttgttttggggygttttgyggttatygyggggygyggtttygggyggggggtttagtagyggygtttttaagtyggtaagyggygaygaggttaygggtttgggyggygttaggtttygttygtttttttygtygtygttttygtygttttttaggtygttatatttgtttttgtatttygagttygattygtatagggggttttyggygyggtayggaagttttttttygttygattyggtygagtaygagtgattygtgagygagtttaygtgtaggttgatttttgtgggggygygggtayggtgggtggtaygaggggatagygtaggtatttggagtttttttygttttttgttttgyggtattgggttttttttaygggattttttatttygtttttattyggttaygtgataggyggagtttgattttttygggaagggttygaggaatygttygtttaaatttyggygattttagggtaatgtggtgyggttggggtttyggttyggatttggggtgttyggygggtaaygtttttttygttttagttttgygtttygtttgggaagaaagygtttygagattttgygtyggtygttgttygtttattttygttttttgtygaggttttygtgtttttttgygttttgtygggattttygtttttgtttttggtagygtygttttygttttygtttttattttygtttttgtttttyggggtttaggttattttgtttttttttttgaggygtyggygygygttggygaattaggtggagatttgggtgagggttattttggtgatgatggttagtatgattttttygtttttggtggggtaggggtttttgyggtgttygttgagttaggttttgagagtggtygtggygtttygygtggygtttttgyggtaygyggggtygttgagttggtaygggtaggtygygttgtygtaygggtggtagttgatggygtyggttatgtyggtggtgtgygygtygtagggtgygttttggaattaataagagtttgtgagtggagtatgyggagatttygygggtaattagttagaggatgttattttttygttygtttayggttatygtttttttygtgagtttggttttggggttgygtttttygtygtaaaagagtaggaaaaaygtagtgtgattygggattagttgttgattataaaaagtatyggagttttattttygaatttttgaattattttatttttttaaaatgatttatttttttttaagtgtttyggagtygttygtggtaatgtatataaatttttgtaygtgygygtatataggtttataggtagttttttgatatttaaatttttgtagatgtttggagtgyggttgtttttttttatttttttttttttttttttatatggttaaaaaaatattttagagtttttaatttattatttattgttttaaagttgggtaaatttaatttgtaatttagaagttagttatygtttygaattttttaaataygtygtaattagtattttaatttattttttaaygtttaaattygaggtatttgtagttttygttaaggttttagygattyggtygttgtttagaaatttygtygagggtyggtagtygygataatttygtaatggttttaatygttygtaaygtgtttygtygyggttygggtttggtttagtttagtaatttygagattygygagtygtttttaggtygtyggagtaggagttgygttygggttayggaggatttaggyggtttttagygggttaygygttygtaagtaygatatttgaaagtatggttygttggatagagtaaggtygaaatttgggygtttygggtyggatttyggagtygtagttgaatgttyggtttttgggtttaattyggtgatttttatygttttgagtttygygagtgaatgygaatygttyggtygtyggtttagaggtygtagtgaygyggattttygygttttaygttaatgtaggygagtatatagttygtttygaaygtttttttaggttgyggtgyggaaattagggataaayggygttagatttyggtttyggyggagaygtattttttaggtttttagagaaaattagtyggygagtygaggggaygygyggggggygygygggtttyggtygggtttagggaygttttygtttgtygygttgttttttttattyggggttyggtttagtttgyggggyggttaatygagtyggygatttttgagtygttagtygygttatattttyggyggttttygttygtygaattygagtttygtttygtttgagtttygtttgggtttyggygtttaggagtttygygtttygttygygttyggttattatgtaggaygggaagtyggyggyggyggyggyggygtyggtygagtattgtagygggttttygaagtyggtggtygtttgygtygtgaaggtygtygagttygggtaggggttgaaygtygagttygaygtygagygygttagtttttygttgygyggagtygttaaagtygaygygtygtaggtygggtaygagtagagygttagygagtygggygtttggtataggtagttttgygggtaggatatggtgggygyggggygyggggttygygttaygtygagtagygggtagggygygyggygttttttatttaygttyggtyggggygyggygyggyggygggtattyggayggtyggyggaggtaggtyggttygggtattagtttgggyggttygygggtyggggyggyggyggggtggyggtggyggyggtagtagygyggagtyggtgggygtagtygygygttaggtyggyggtyggggtttgggggagtttggagtygggagtgaggagttgaggaaggagygttygagttttygagggatattggaaygygtagttgtttattaygygtttatttgtatattygggggttygttttttttttgtttygttygttgtagttttygggtygyggttgggggaggggtagagagaygggagggaggygggggagggyggaggygayggaggygggyggygggagggatyggtaggtttttgtggygtagtygtttttttagtagtttyggttttagttygyggttygyggatttgtagtttagttyggtygygttgygtgtttyggygygtattttttttatttttatttattyggagttaygttttttgttyggtttyggtyggtttttatygttttyggttatygttttygtttttgttyggttttygttttttttagttattatttygtttttatttttttttttatttttatggattaggtagaggtygttygyggttaggttaggtygggtttaattaggggatttatagtttgtttygttgtgtatttygaggaggttyggtttttgtgtttaattyggaagtygtagggaagtggggaggttaggatggtggygttygyggttygggttttttttygggtagtgygygyggtttttatttttayggtttyggatttgttttgttttttggttygaggtttttygygtggtttygygtttggtygtttatttttygyggtttatttygtttagtatggatttggattyggggygttttggttgygaattgttaggagggttttgaggtgagttttttgtttttaaattygtagygtaattttyggggttttgaaygttaygattttttattgttgggaatgaygttagggttttagttaagaagaygtygttttttaaagagttttattttattttgtttttttaagttgattttttttttagatttgtgttgttaaaatattggggggatgattgttatttgataaatygtttttggtaggatttgaagttttttagttaygtygagaaygggtaggagtttaggttggygtygtyggtgtagtgggtattataggtagtttaggtgaygygyggttggagtaggggggyggttgttttgyggggtttagaagygaggyggttggygagggtttttaggattttagttttttagaattttttttttattaygtttttttaatttttttttattyggggatggtygaagagggygtttggttgtttatttygaagggttatttatggggggygtttagggggatggaagagtgttaggtttgtgttggtttattgggagtatttatttagtaggtgtttttattttyggaagtygtttygggtgggtgyggtggagaagagagagygtagtggtttggggygggttttagtttaggtttgtagtygatttttgtatttttgttggttttgtagtttgyggagtagttttagtgattttaggaygtagggtatgttgyggtttttttgtggtgyggttgtagyggygyggagggagyggagttygggttgttagtttggtttagggygtaagagaaatatttayggtattaggttgtttttttttaggtgtaagggaattagttgtaaattgtagtgttgtgtttgaggatggttttttttgagtyggtaggttttyggtaggygyggtttaggtaygttatttttttygttaggagttttygagtygagttattygttttttattagttattttatttattttttygtttatattgtttttttattattttttttataaattatatttttattttgtatatattttttttaggttattttaatataygtataygtatatatatttaygattatttttttttttatttatagatatttygtttttataggttgggttttttgtaaygatttagyggggggttttaattttgttgygattttatatgggatattttaatttagtttaggatagatatttttaattaattattatagagttgaaaaatagagagagagagaaagtagtygggttgggtaagtygtygatagtttgygatatttttgygttttttgggagggaatttttttaagaagaggggtaaatgagaggtttataygttggatggtaaatataaatattgttagattagatggtaatttttagggtttttttaygattagattagtttaaatgaaaaaaaaatygggtgtaatttttattattagggagtattggtttggagtatttttatttttaaagagyggttttygttgtggttttattagtatttggggtttatttttttttttttttttttgatttattttttttttttygtyggatttttgttaggggtagaagagaaaatagttagttattatataaatatttttagtttggagttggagtgtttgttttggatatagtygattttgatattaattaaatatataattagataygtgtagtggyggggagggtttttttatttagggtgtatttttagaaaygtygtttgtttttttttttttttagtttagtgttgggagtttgaagatggttttttttygttttgtgtgtattttttttttagtaattatatttttttattgaaatttatatgttttatatygttgttgtttgttattaataaaaatygtttattttgtattattaaatagtygatttttattatatgtygtttttattggtagtgattgtagtaaattaaaatgtttaygtagggatattaaaaatttaatattygttattgttattgaaatatataaattaygttttgttttaaagttttttgatattaaagaaaaaaattatattttttttttttaagttaaagttggtttggttttttttttaaaaaaaaaaaaaattaattatgagaaaatatgttgttagygtggagttttggygyggyggtttyggygaggttgtttgagagggtggygggtttagtttagatttygtttyggggttaygagggttgtaaggtygyggttttygaagaggagggtttgggatgttttgtttaagggygaggyggggtgtttaggtttgtggggtygttggggagagttyggtatttggtttttgaggttttttagttgtygttygagtaggagggagggaatgagtaggtaygtagggaaaatttagtaattgttttgtaaaygygatttttggttataataatttaggygatgggggtagttttaggtttttggtgggttttgtttttttttttaggtgtgttttaggaggtggggaaaaaattaatattgtttttatttttttttattgtttttgtaatagttaaagaatttagaaygagtttaygtggataygtaagttttagygagyggggattttttgygaggtygagygygaggaatagtyggtttyggaggttygggttyggggttttttyggggaygyggtygattgagaaggtyggggygttygtygggygyggygtygtttttygtgtygyggggayggaaggaggygaygtaggttaggagtygtgygygygggyggygagggggygttgtggttygtgtttgtyggttygagtttyggtaayggtgggygygatttattttttttttyggyggtttaattyggggaagaagaaaaaayggtatygaggtattttaataaaatttaagygatttttgatttttttttattgtggttttttatgagttttyggtgtttggyggggaaatagttatygttygggggtgtggtaaatttttttggtaattaagatgaaatagaygtttttatgtgggttttttttaatgaagtaatattggaaatgtaagtagttttagtgtattaaattatatygttatygtattygyggttatyggttttttygttttagggtttttygygtttgtygagggagagagygaggtaggaatagggggtyggggatatgagaagtttggttaagaaattttttttttttttgaaaataaaagygttgttataaatggaataaaatttaagttaatatggaatttatattttttttaaaygtygtttttaggtttagtattttgtgagtaggttggattggattttaygtttaatyggtatttttaggtttttaaagaygttttygaggtttaaatgtttttttggaaaataygtgtagaggagtattygtggaagattgaaaggttttygtagttttagttttggtaggatgtgtaaggtttttygaggtttttaaatgggttttygaggtttgggagattttygagtagttaygygggygttattttagggaygyggggyggyggttattgtgggtygggagggttttygtaygggttgttttgagygtttggattygggattttgygygygtttttttttttttttttygttttttttttttttatttataatttatattttagggatttygtatttagttaattagtttttgtttatttaattgttttgtttttagtttyggatttttgggaggtttttttatggttaatttgtttttttyggtattttttagygttttgtaaaatttgttttttttttatagatgtttygttttygaygtgttttttgaagtttttttttygtttagggtgtttataattttgaattttttagtatttygtygatttygtttttattttttttttttttttaatttygygttggtttygttttttttttttttttttttttttttaygygtttygttttttttttttaggtygtattttttttygttygggtygggagtttttygtggttaggygttygygyggtttaagatygaggttygttaygttgggtygttygtgggyggtttttattyggtatatygtggaaayggygygtttygttagttgyggttttagtttgggagggagygtagygyggggagtttgtagygtttggagagtgaggaaaagggatattttttggaaatggatagagtygagttttttaaagggatygtagttgaaagagattttttttaaaattagtaaygatttggtagttttagttttttaataggagatggttygaagatgaaatgtttgaaatttygtygtygttttatttttgtatataygygtayggtaggtttagattygtatagagaygtagataygygygygttygygtttttyggagaggtyggygygtttyg

SEQ ID NO: 11011 - DNA, 1059 bp, Artificial Sequence
  Description of Artificial Sequence: Synthetic polynucleotide
tyggtttgttatygttttttagggaaygagatattgttgagttggaagatttygygggttataggtatagtttttttgttgttggyggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygttggggtttygggyggtayggggygygggtgggtyggttggtgagygttatygtgtttgttttyggtttgttttgggttttttattaygtagttaattttttgtaggyggtygtagygttggttttatyggaaggggttttggygaagttgggyggagtyggttaggyggygygagygggaattayggttttggttttttttagttttagygttaattyggtgttttaygtttttatygttggagatttgttgtttygggtaggttttygtttttttaygyggtttttygaaggttttggggaggttygagggggyggtygttttagggaagggattatggagtttygaattattttttagttgaaagtggtggggtagggtygyggtaatggagattyggggggtgggatggagaaggayggttyg

SEQ ID NO: 11012 - DNA, 1663 bp, Artificial Sequence
  Description of Artificial Sequence: Synthetic polynucleotide
tygtttttyggttttygtttttygtttttygggtggtgaaygtttgaagagggaggygtggtttygygtattttgttttyggtygygttatyggtatttatttggttgttgtygtgtttttygttygttttyggggttygagatttygygggatttygygtyggttttgygggaggaggyggyggttttagtagttgttttaggtaggyggtgttyggtagagaggagtttttttggtggtataagtgygtttyggggttttgaygtygtgtatttttatttygggygyggttttttttygggggaggttggggtgaggaggatagggaggatgaggyggaggaagaggaaggagttgagtygggggagygttygttaggaggygtttttttygttgttttygaggtygtygygggtttttttayggyggggagtaaatgttygyggattyggyggygtagygtggatttttgttyggttttgtyggygtygtygggttttaggggtttyggygaygagtagtataggttgggttgygaggaggagaagattyggtttagtatttgttttygttttttgaagtygttttatttgttgtttgtattattttttttggtyggtgtattttttgtgtttatygggggtggyggggagggygayggggtgttygtagtgyggygttttggatttttagygygttygttttygtygtttttgtttttgtttatttttagttgtaggtttttttagagtygggtttggaaggaggaggaygtygtyggyggttttggttygttygtygyggtagttyggggttttattttttattttttgttttttttttttttttttttttttttttttttttttgtttttttttttttttyggttgtattttttttygggtttttgyggygttggyggtggyggyggyggyggyggygggygtagtagtagaaatygggagtgtttagygattttaggttagttygggggaaagaagyggtygtygtygtygaggttttttggtttygggatttyggygttgtttttttttttygtatttgttggggtgggttggagtygtaatygaatttyggtygyggygtttgtaaagtttttttttygaagtttygyggttttagtttattggygttttttaggtygygttttggtttttttttttttttgatygagttygggaagttgtaygtatyggggygtgygygtttagttgygttagggatygtattyggygttttttgggtagtatttgttagyggygggggyggttgtttttaaattgggygygtaygyggtttatataataaggygygtttggttggagatttyggggattagtagtttttttggggygtttygggattattttttagtttttaggtgggagggtyggtaggagtygggtggagttaggtagggttygaagttagtttgttttttaggattyggttatagttgtttaggtagttygttgtgygttggtygttggtygygttggygatygtttgggtyggatgaagygagttggagtggaaattatgtgttttygatgggtttygtgggggygtygatygtttatattgagygatgaattygayggagttttaaagttgaagaygtttgttttygtttygttgyg

SEQ ID NO: 11013 - DNA, 2065 bp, Artificial Sequence
  Description of Artificial Sequence: Synthetic polynucleotide
gyggatygyggygtttttagggaatatatttatttagtaatygagattagagttggagygttgygtttttaattttggggygggyggggggyggygggaatttttgtttyggttttttttgtatygygggggtagttgttatttgtaaggygagygyggygygggggatggaagtaggygtttattggatagaatataaaggtagaaatttatttygaaggtyggggttyggyggggygttgggggtgggygtttttygyggttttyggygtttttygtttygagaygtttyggtttagyggtattggygygatygaggtttagtttyggggataygttyggttggtygyggggaaggtattaggtgagygyggtygygtttttyggaatttygttttygygygtttygyggygaygyggygtttattygtttygggagttaggaatttagggttttattatggygttggtygtygtygtygtygttgyggttgtyggggtgagttaggyggyggtgttgggttttttgtaggagtayggygggaaggtgygtaatttygagttgttgagtygttttaagtygttgttygatgtyggygattygyggggtygygtygttygtagggatygttttaagtagttygttaataaygtggyggtggtgaaggagttygayggygttaagttygtggtgttgaggaagaagtttyggttttyggagttygagttygtatttttyggtttttygggggtagyggtttagtygtygaaatttatttygayggttttgtygyggagygtttttgtttygggagtttygtttttggttygggtgtygyggttagtggagtygttaggggatttgggtttgttaatagagttataggatatttygggggggtyggttttygagttygtttagtygttyggggagyggttygtygatttatygtttttagtttttgagttagtttaggttatygagagatttttygtagaygyggttttatygtttagggttttttttgaggyggtatygttttgttttgattygttagaygyggagttygggttyggggtagygaaagggtygtygtagtagaagttttgtatgttgtyggtgygttgygtttyggttttygttaygtttygttttygggyggaggagttyggtttgygtyggtagttgtyggaggagtygagttygyggagtttttttttgttgttgaggyggttttyggtggaagagttyggtttgggtttyggtttgggttygggtygtttttygtatttgaggygtttgtygygygtyggttygygtttgttgagttttgaygtygaggagttgttygtygygtygtygtygttygyggtgtttttggagtygttygagtaygagtggttygtgyggattgtygggggtygttggatttattagttgtaygggttgttgttgygygatygyggtttggyggttaagygygattttatgtttggttttayggttttgtattgggtygttaagagyggygayggygagatggygttgtagttggtggaggtygygyggygtagtggygtattagtygaygtgaaygtaygtttttayggyggttataygtygttgtatttggttgtattgtayggttaygaggaygttgtygtgttgttggtggtgygtttgggtgtttaggtgtaygtgygtgattatagygggygtygygtttattagtatttgyggttyggtttttygtaygygttgygtygtttttttggygatttaggtttgygaggtattayggagttagatgygatyggtggtggaagtggtagttttgttgttaggygtttygtataggtggtygttattatttttagttttattattagtgtatttttgggygttttggttgaygattttatgttttaggatttggttygaggtttgaagaagtygagtttttttagtaagtttttgagygtttygtttatggttttaygtaaaaagataaagattygyggtggtttgttagtttttttagaaatttttygtygatttatttyg

SEQ ID NO: 11014 - DNA, 3487 bp, Artificial Sequence
  Description of Artificial Sequence: Synthetic polynucleotide
tygagagaaggtgagttyggygggygtagygggttgggtgggtgtggttygyggtttygggaatagatttaaggtttygttatygtyggttagtagttygatagttygttygtttggygagygtaggttttttttttagaaattgygaggattygagygtattgtttgtgtattataaggttaagtygggaagtggagtyggaggaggaggggygaggaggygaagggtggggagaggggygtttygttttttygttatgtgttagtttttggaagttatttttyggtttttaatttttyggggtaatgggaaggaagagtaaggaggaaggggtygtttyggggtaaaattttgttggggttaggatgtgtaattatttatttattygtttattattgttttttttatttttyggaaatgyggggtagygttaggygttaggaggtattygggaggggggagggggygaygagtttaatggggattttttttayggatygtttttttttttttgaggtygtttataattttaagttttttygttyggaatgttagttttttatttggagtgggtgyggggaggagggtygygttttttttttaagattygygttygtttttttattttttttttgttagtattttttgtttatttttggtgttgtaaaaygttaygtaatttattygattygtattttaaaattagygatttagaagtagggtttagggygagggttttttagygttggagtttyggggggyggggtgtttagtgtaaatttygtttttttygygagtgtygtttttaggttgttatttgtaaagaaaygtttttttgaygtagggagaaatggtaaattttaagtaygttattaatatggygttaaaagatttttttaagtataagttygtttttttttttttttaaggttgyggggggygtygttygggtttggggygygtagggggyggggtgtgagtagaaagtgtgagtgaaagagtggaggggyggggtatgtgtgtgagtgtgtgaagtgtgagtagatttgatgggatttgtaygggygtagtygtygttygggttyggttttggggatagggygggttaggggygttttagagtttatggggagttygggtttagggtgttagtaggygtggtggtggggttgygagggagggtattttttttttayggggttygtaaygttatttggatttttygtyggagttaaataattgggyggggggttgggggggyggygaygggggtgtygggagyggagattygagtgaataagaaaaaagtggttattttttttttttygttttttttgttygtttttattttatttttattttaatatattttttttttttaaagagattataaggaagttttggtttaaaaagaaatagaaatatatatagggggttggtgaatggtgtygatygyggttatygtagttggaggttattttttggggggggtgagtagygtttatggagttattttgygtttatttttagyggtatyggtttaggttttgygggtygatygttttyggyggggggygtggggtttgggaygtygygggttyggtygtttttttygtygygatttyggatggatgygygtttttygttttttygygtyggttttaggagttttyggtttygggagtatttttttygygtyggtttttgtagyggygygtagtygagggtagygttygttaggggggtatygyggagtaaggtaagatttagttttyggyggatgggttttgygtatttttaygaygttatttggygtttttgtaatagatttgttagygtttttygttttttygtttttttttgttygttygtttttttttttttttgttggttgtttgttttaggaagttagygyggagaggggggggatgtatagtataggggagagagattgygtatgttggttagtygtgttttaaagagtatagtgyggggaggttgagaggggygtatgtaataataatttttggaagggtgagtttggygattttttttattaatgattgyggtaaagygttttygggtyggygagggggygygggygggygggggygygttagggttgtaattttttygygggtttyggtygggygtaggggttgyggygggagatgggtayggtggggaggtygagyggttygggygggggtttygagaatttggagttatttgtttttttgttttttygagttttattttgttgataygtagtaygttygggygtygaatygggttgagtyggtgtatatgatttygygttgggtttaygtgtagtyggttyggttttagatatttttygggggttatygttttygttttgtygttttttttttyggttyggtgtaygygggygttgtaygygggggtagtatgttyggtttttggggttggaggttttgtataaattagatagtttttttggaggggygggggatattttttttaggtgagtgtggagggtgyggagtttyggygttaggggtgaggattggggtygggggtagtttttattttyggggtygygyggtagtttagttggggagaggygttgggagagtggaaatgtatyggyggyggtyggagyggygggtgygygttygyggggygayggtagggggygtggtttttgtttatttttttttaattttgtyggttygygtttygttttagggayggattygtagtttttagttttttgtttagggttttgtattatgggtggtattaggaagatgtyggtttgtggyggatttygtttgggaygtatatatttgatttttaaatgagtgatattgtagttttygtttttatttagygttgttgtagtttttttgtyggattttyggtttygtttygttttyggtagtggtattttttyggttttatttttttttttttttttttttttttttttttatttattygtttgygtttgyggagyggygttygttygtttttttttygtttgggtgtagatttgtggttttttatggttttttttygtttatttttgggttttgagatatttttttttttyggttaagggaygagaggggttaatttggygattygtagttgttttgttagaggatggggttgtttgygagatagttaggaaggttttattttagtttttagaggtttagttttgttttttattatatatagttattattttattygtttttggggttyggttgtttttttyggtgttttttaaatttttttttygatttgggtgttaagtttatttatttttyggygtygttttyggtygaatagttttttgtttttttttygtttgggtyggagtttttygtagtttttttyggttttttttttyggtttyggyggtyggaattaygtyggygygtttttagtttgyggtttygyggattgtttttaggggygggttggaggygygyg

SEQ ID NO: 11015 - DNA, 847 bp, Artificial Sequence
  Description of Artificial Sequence: Synthetic polynucleotide
tygaggggaaaggayggatttggygtttggggttttttyggtgggatttaggtgggtggttygygtggggtggggtaggggtatttataggygtttagygttgygggggatgtttygaggaatygygyggaggtttagttygtggtagtttaygttggtagyggagtaggtatatttggtggggtaggygayggttggaggtttatttaggaygttygttagygttaaggttagygttaggygggygygtayggyggygtygatttttgtttattygggggttatggtgtgtagggtttygtttttggaggaggttgtttttgyggggtaagaygygtggagttygaggaggygygyggggagygygggyggtttggggagygggyggyggagttagygyggaggaggggygagttyggtgtttaggygtayggggygygggyggagyggggygtttygggyggyggyggyggtagtaatagtagttttatyggyggggtyggygttgtttygttgygtatygttgggagtgtttaggtgyggagygttttttggtttygttggttygygggtygggttggggatttggggygagygtaatggggygtggygttyggggaggttyggtttggggttgggttggggagygyggyggttgyggttggggtayggggyggtygggtgagttggtyggygttygttttttttatttagtgagtayggtagatatyggagaygyggggtttattttttyggttttttttygattaagaaaygttaatttygttttttattggttgygtygygygttatgtygattaagttgggaattttgttggagygatyg

SEQ ID NO: 11016 - DNA, 909 bp, Artificial Sequence
  Description of Artificial Sequence: Synthetic polynucleotide
tygtttagtatagayggggtattttyggtgyggtttgttatygttttgtttggygttggygtttttagagaaggttatgtygattttttttttatttygttttagatttttttttttgagttgttttttttatagtttttttaggygttattgagagtttttygttttygatgggtttggggygtttggattttttyggggttattttgtygtttttttttagtttttttttttattttttgtygtygttttttygtttttttaggattttgygtatttaggttggttttatgttttggggtattttagtagtgttttygggttttyggttattyggtgayggagggagggagaggttggygagggggyggygttttaggttttagygygattygttttttagtttttttygtyggttatagtygygygggayggggtagggatttygagaatatyggggatttgygggtyggtggtttygggtaggttatttttgaygygggtgygaggtttttygygggygtgtayggttgggtyggagtygygtygggggtygggataygtttggggttagygttggygtygtygttygggtggggtgggtygggttygggtttagttttttttttaygggyggttygygtttygttttttagtgatttttatattttttgygtttygagttggaatttyggtaggttttgtttygggtygygygygttttttggggattagggttgtggtttttgtttygygtygtgtttttagatatygtygggygttygttttttatttttttttttttttttttatttygyggttgaygagggtygtttttaagtggttatgtttttyggtatggaygattttttagtgtttttgagggtttagggtttygttttygtttyg

SEQ ID NO: 11017 - DNA, 2150 bp, Artificial Sequence
  Description of Artificial Sequence: Synthetic polynucleotide
aygtygygtttygtygttygygggttygtygggagattgygggttygtttygygggtggggygtttyggtttttttygttttttggaggttataggttayggygayggyggtgatygggagagtaggttgygaggygygttttatygggttatagataaattatttyggtagyggtygygtyggaattttttttaagttattaaattygtttaygygygggagagtgttggggatgttttatgygttygygattttagaagttaggagtgtgttatttttttatatatttattttyggttttgtaygtttttttttayggttygagtttttgtaaatgtttggttagatygaggtygtygagatgttygttttagttttttttttygtgggtatttagggtagttygtgagygtygttygtygtygtttttagyggygtygggttttygaatattygtygggtgagygaagtatagyggggttayggagygtttygaygyggggayggggagggtagtgttttttttataaattagttttttgggtgaagtttttggggtttggagattggagtgtagggtgtgtgtgtgtgtgtgtgtgtgtgtgtgttgtattttgattttatggaggatttgtgggagaggaggtgtaaggttttttttttagaagtttggygtttttaggttttagttaygygggaygtttttygataattygatttttygttaggagagattygatttaggtttgygtygygaggtttttagttygtttttttttgygattttaaatttgggttttgatttttygtyggtygyggtggttygggttattyggyggyggttgatagttgagygtaaaggygtygyggttaaggttttygyggagtagttygggatgygtaygtygagggttaaggaggaggtygttyggtttggagttgggatygtaggttgggggtygggatattygggtttygtygggtygggggtagggtygygggtttgatagttgttgyggttygygyggaygygygttttttgtagttygttttttttatgtttgatttattattttttgttttttttttttttgttgttttaaaatatttttygaygttagtaaaatataatgygtttyggtygtygtaaatagtygggagggagagtatatattyggygyggygyggtygtyggttyggtttttatttttttttygtttttagaaaatgttataaaagygggtagggygyggggagggyggttgygygttyggyggtyggggtttttttttygygtygtttttttaygttttttygttygtttygygygttygtttttttygtaaatttgtttygttatttygtttagyggyggggttyggggttyggggttygggatttatttygtyggagaattttgygttttttttygttttttttttttygygttttttyggttygtagttttttttyggtagtyggygaggtgggtagttygtgggttatygaaagttygyggaggggaygygtattatatggtagttygtttttagtttttygagtgygttgggaagggggaggggaaggggygaggggaggtyggggggaaagygagagyggggyggyggygggagtgggtaggyggggtggygagggyggyggtygtttaygttagygttgtgygatygtagttygggygtgtayggtygttgttgtygttgttgttgttgttgttgttgttgaggyggyggyggttyggygttgtttgtttygygtygygyggtttgygtttttttyggaaygtttatatttttaatygttatattgttgatattyggygttgaygttattygttttttatttataataattttaygggagtygggtagygtattttttyggtygttggggygyggtaygttyggygattagygtaagtygtttygygaatggygtttygggggttggggyggggggygggggaygggggygggygygygygtttygttggttygygggagggggygygttttatgtygtygtagtagtagattttttygttttgtgyggtygygyggttyggagagtttttttttttyggttyggttgatygtttygttyggtttggttttttyggttaygaaagayg

SEQ ID NO: 11018 - DNA, 506 bp, Artificial Sequence
  Description of Artificial Sequence: Synthetic polynucleotide
gygttygttgttttygagtttygggtttgagtgttggttggyggagatttatagtgggtgtttygttttyggaygatgtttttgggtttttagatttagagtttygggaygaaattgttttaggaagattyggaaggattygtyggtygyggtaagggataggyggtttttgagataggaggagttaggaaatgyggggtttggtggggtgaggagtayggggttttttttttattttygyggggattttgttatyggtttagtgtggaggttttatygtttygttyggattygtggggtttygatagtgtggtttttgygaggattttttttatttttttygttttggggttgttgygggagggygttygggtagtattaggttttgagtgtttagggttyggtaggggtttttygttgtygtttttttgatttygtygtttgyggtttagggttgttggttttttygttggtttgggaggttttagtatggaygtygtgaggyg

SEQ ID NO: 11019 - DNA, 1503 bp, Artificial Sequence
  Description of Artificial Sequence: Synthetic polynucleotide
tygagtgggaygaatttttygttagttttgggtttttttatttgtyggttygyggtyggygtyggtataggyggagggygtttttttttttttgyggttttaagttaagtggaagatttttttttaagttttttttttygaagtttygygggtttttygygttttagttttagttatagtttgtggaggyggtatttygaggttgggygttygtgyggygttttggttttagtatttttygtttygaggttyggtttygggggygyggtygttygggttttygtgtgttttagggggtttygggtygygagtygttgtygaatggtttttgataaaaaaatttttgattattaaggttagtttttttttgaaagtttygttygtttygatataggaagtagaagggagygagagttttagagygyggyggtagyggyggtttggtttttttagagggttagagttagggatatgygggygttygggatttygygtttygygyggttyggygtttgagygttttygtttttygtttyggagttgtyggyggtatgattygataygtyggggygttygygygyggggattttayggggtaagttygggyggtygtttttttttttttygygatttttayggttygygttttggtygttttattttattttttgttttagagagtttttygggygygtgatttyggggttgtygggttgataygggatttttatygtggtygaggttagaatttggttttgyggggtagggggyggttttggtgatttygttggattygatgttggttaaatttttaaggttaggtattttattgggaatttagtgtatattttaggttgttggtggayggattaygagggagtgygtygttatttgttagygtyggggttgttygygtggaygyggttttttttttggygtttgtttygtttgaattttgtaaataaaattygyggttttagtttygttagtttgttgtattygttgttttgygagtygtagygygygttttygggtattagagtttygttgggygtggggtyggagattyggattttygtaattttgggtgttygyggtttaatagttgatyggtttttttggatygagggtttattgggtttttttttygtygtttttttgttttggtygtagayggtgattttyggatyggttttggtygagtttagtgtttgggtagggtttagggygtaygggttgygygygggttgtggatgtatgaygtygaatggtttgggaattgatttggagaggagttttyggtggttaagttttygtttygtttttttgtygtttttagttttatttygygagttygggtattgttyggggttgggttttgggagaaagttttttygttttgtttagtttagagggygttttgagaagttttaggtgttgtagagaygttyggtyggaggyggattttyggggaaagtttatttttgggtatttaggagygyg

SEQ ID NO: 11020 - DNA, 907 bp, Artificial Sequence
  Description of Artificial Sequence: Synthetic polynucleotide
tyggatyggtatagggggayggttagaygggatgtyggaagttaagggaygtagaggtyggygggtggyggygatggagaggatagattyggtttttagaggaggtygtgagygyggggtttgygtyggtyggaggagggattyggggggttgtaatatggttgttygggygtygttttttttttgttaagttagggttttggggagttgttgtygtttttygttygggttggggygaggaaaggaggggayggygttgyggtttyggaatttgtattgygattttggtagagtaaaygttgtatttgtagtttygaattgaattttttgtttttttttttttttttttttggttaygttttttttttttttttttattattttattttaattggttttaaaygagggtgaaagttgagtttgaggatgtygttgttatagaaattgtatagtaattaagggttggggaggyggggggggggggyggtaggttttttttttttatttttagtaygygtatatttttttttatttttttagttygtygygttttttyggagatttatatygttatttttygtygtagaaygggagggataggaatayggayggagggatygggaygaggggagggttttaygtagtatagttgtttttttgyggagygtttaggagattygggtatttttggaagygttgyggattgagttgttygyggttgttttygtttygagggtygggatagtattttaggagaagagggaygaagagggaygatagataaatagttggggagaggygggggggggyggttygtggggttygttgggttttatttagttttgttyggagttgttygaaatagtatttaggtttttgygggttaggatgaaaggtaygtgggtyg

SEQ ID NO: 11021 - DNA, 1925 bp, Artificial Sequence
  Description of Artificial Sequence: Synthetic polynucleotide
tygtyggttttaagtaggaaggygttttyggtatattagttttttttagygtttttagygggttyggygtttggagggttaaggygggygygtttygygggtgggyggggggggggggaygggatyggtgtygggagtttygttgttttggygttttttgggtttaggtttagtygttttttgggtttttttygyggggtygttttygttttttttttgtygagaygggygtggggtayggggtygtygttyggyggggagtttattyggyggygtagaygtttygyggtttyggggagggatttggtttgggtttyggtttygygtttttttggggaggagtygagaggttgtagttggyggyggyggtttygggygggagggggttttaggaagyggttaggtyggagttttttattyggtygtagttgttggtttggttagaatygagygygttttttyggttttygtygtttttttttgtaaatygygggtaggaggagttttttttttagygggttyggagtttagaggygtygyggggygyggtygaggggaggaggaaggagagygggagygtagtyggttygggtttagtygtgattygtggggyggyggtttygttaatttgtgggygttgaygyggggggyggtttygyggygttygatatttgttygttygggaygyggggygtygagaggttyggttaggygggagttgygttyggggyggtygttgtatttgttygggatttygtyggtygtttttygygtttatttttttygtttttygttttttttttttttttagtttyggtttttygggygyggygtgagagtagagttyggttyggaggagtygtttttttttygttygttygttyggygtttggagaggagygygttgaggatygggaygtttgyggtygtygttatygtttaggttygtygygtttyggtygggatggatttataygttygatgagtttygygtyggyggttgygagygtygagtttttttttgttgyggttttagtygtttttygygygttyggtttygyggattaggatttttgggtttttyggttgagggygyggtygtttyggagaggtygagyggggaygggttygagatggygyggggatttagygtttyggyggygggygttttgtaygyggttygggttyggggatagtttyggagttggtagtygttyggtatygatggattttgattygygaggyggygtygygttygtgtttagttgtagttagaggggygygygggtagaaygygttttaggttygggtyggttygygyggttatgaagatgatgttggtgygtyggtttygygtgtttattttgatggtgtttttggtggtttgygygttgtatatygttttggatttgttgtttaggttggagygaygyggygygyggttttygggggagttyggttgttygtgygygtagttygtygtygaggtggtygygttyggttgggtttaggttyggggtygtttyggggagttttyggtygtttttttygtygtyggygaygygggttggtttaataagtataygtttygtattttgtaggattttagtttygattttttttttaatttttygttttattygttggagaaattgtygttygyggtygagtyggtygagygygttttgygggggygggatttyggygttttaagattttaygatttygygtatyggtygttgttgygagatttyggttygygtyggttygagtygtttttyggtttyggyggagaygttttttttttggttaggttgttygagtattygttttatygggtggyggtttygtygtttayggaggaggaygttttgtttaatgtgaatagygatattaggtttagttttaaagyggyggagaattyg

SEQ ID NO: 11022 - DNA, 1287 bp, Artificial Sequence
  Description of Artificial Sequence: Synthetic polynucleotide
tygtggttyggaagtggattttgttygaygygggggtggtygttggagggtygaggatgtttatataggtttttggagggtgtgttttyggagtttgtttygttttttggatttatgggggattagtaaygtygttatatttttttttgtttttgttagtygttttttygttttttttttttggttgaggttggtaaaggtaggtaggtatgggggggyggggttttaggagggaggaggggttggtgggyggggtttayggatatttygtttygtttttagtggggtttygtattttttatatttygyggtttttttaggttagggttttttattatygygtttagaggtygggttagtygggygtgtattttaggggygtttygtttttygyggtttgggattttttagttaggatagtataaaatttttttatygtttattttttgtaaaaaatygtggttttyggyggattttggagataggaggtgtaaagggygtttataygyggttygggttygyggtygagagttggggggatttggagyggggtygggtygtaagaagattttgattttgtttyggygttggggygygtgttaagggttygyggggtattagttgtattttygaatttttgtgtttggtyggggagtttttaaggttttatttygttttggagggggttgyggaagttyggaggtgattygggttttgggaggggygtttttaaygtgggggaagggagataggggttttygaagatagygygagattyggagggggttttttygatttaagaygtggtaaattgaggtyggygaggagygaggttgagttyggggattaggyggttttttattgttttttyggttygtygtttttttgygtttgttygtaygggtagggtyggyggtygagtttagygggttyggggttaggtttgggtttygggggyggygttttttttttygygtygtttttatgttygtttttygygtygttttygttygagttgtttttttttaagtagtygttatygygtattttgtgttggggtygygggatgyggggttggygyggggttaygtttygtygtagtttttgttttattygtaggtaggagatygyggttattattagygttattagtagtatygttagtttagtttgggygtaaggagagggatgttagggattygyggtygtttygtttygtatttttttygtttatatttttygttgagataggtttttttttttttygggagtttttygggttaygyg

SEQ ID NO: 11023 - DNA, 2906 bp, Artificial Sequence; identical to SEQ ID NO: 6069
  Description of Artificial Sequence: Synthetic polynucleotide

SEQ ID NO: 11024 - DNA, 2146 bp, Artificial Sequence
  Description of Artificial Sequence: Synthetic polynucleotide
tygygtgttaggaaaagttgtgaggttggaaatttyggagtaaggttygattttggttagatttgtaggttgyggaatygggggygygygggygtagygtagtatagttyggttatggagtaygyggtggttttttgygttttttatttagggattgagttyggggttgtyggggagagygagagygagggygtygygttttyggygtagatattttgtagtttyggygygtttttgtgttttagtttyggggaagagttttygtygtagtttttygttttagyggyggaaggygyggttattttttygttttttagyggtggttygygggtggtggagyggtagtgggaggtyggtagygygggygtygygttttyggaggagttygygttttttgaggagygygygtgttyggaagagttygyggygtygtttttygaatygygygtttggtttgaggatttygygtttttygaggagttyggggagttygygttygtattttyggggttyggggyggtgtayggggagtyggatttggtgttggaggtgtyggggygtyggttgygygygtataaggyggtgttggyggygygtagygattattttygygygygygygtygygggaygtgttgygggtgtagggagtgagtttgayggygttgyggttgtttttygtygaygtttatagygggygtatggygggygtgyggttygataaygtggtygaggtggtggtyggygygygtygtttgtagttgttyggygtygygtagygygttatygaygtygtggggtygtagttgagtttggttaattgttaygaggttttgagygyggttaagyggtagyggttgaaygagttgygygaygtygtttattgttttatgagygattattatttggaggtgttgygygagttygtygtgttyggtygtttgtygggygtagagygggatttgttgttgygtygtygtttgygygtyggtygygtttattttttggtygyggygttygggtyggygggggagygygygggtagtyggttttagagtttttygggggaygyggaygygygyggggaygyggtygtttattgtttttaygyggyggtyggagagtggygygagttgaygyggttgttygagggygygtyggygyggggttgyggtttgtgygttttttataattattttttygtggygggyggygtggygttygygggtttygayggtygygygygttygttygattaggttttttgttataattyggttayggatagttggagygtygtgaggtttttgygttaggygygttygtagttgyggttgttggttttggayggttatttttaygtygtgggyggygagtgtttgtttagygtggagygttaygattygygygtygatygttgggttttygtggygtygttgtttyggggygttttygtygtggygtatgaggttattatttgttayggygagatttaygtgttygggggtttttttttttatygtttgtttaagtatgattygyggygygaygagtggtaggagtgttygtgtagtagtagtygygagygttyggtygatatggtggttttygayggttttatttatygtttygatttgagyggtagtygyggygaggygtaggyggyggggtygagyggggttagygtgtttygatattattgtttggttaagtagtggagttygtgygtygygtttttgygttttttyggyggttttaygggtttgtagttttttygttgygtygttttggayggygttatttattgygtgagtygygygggtatttggygtttttagtttgttygggaaggygaggtyggyggygaygtaggttagggyggyggtttygaggygttgggygtttttttggaygttyggggtgtgtttatttygttygtttttagtttgtttgagaagtygtttygaggggagtagggygtttygtaggtyggyggggtyggygggygtttttttyggtaggggtttgyggggtttaggtttttttgggttygyggaggaggaygtggtggggagtyggggtygttggttaygttggtggtttggatatttygaaggagtttygaggaygtttttagggtygttttyg

SEQ ID NO: 11025 - DNA, 865 bp, Artificial Sequence
  Description of Artificial Sequence: Synthetic polynucleotide
gygttttgygttttttttttaygttatttgttagggagtygttaaatagtaagatygygygttttgyggttttagagtgyggatttyggtygygtgyggttttgatygygtygttttatttttggyggggttaygtayggaygttatggttggygtygyggagtygggygatgygygyggattttttyggggttttgattgtttttgagttttttttgyggggggygtgygyggttygtttttygyggygttaygyggttttttttyggtyggggattggtgygttgggyggggyggggyggggygggataaaggygyggggtttggttgygyggggtttgygggtagttttaattttgggttygtagtttgygttgggtgygtaggaaggttagtgtgggggtygttygatatttttttttygyggaggtgggagtygagttatattttggagtggggattggtygyggagygggttgtttagggtyggtygaggtyggggygagttttgygyggygttggagattttgtattttygggygygygtagggttttyggtygtggtygtagagttaggaggggyggtttyggagttyggygyggggagggtttaggygtagtyggggttggtagggygygatattygtttttttttatttttgaaagggttttttaygtygagaagaggggygggtatggtyggttyggygaaatyggtttgtatagattttgggaagttatygtttgyggagggtgggattttatagtttgtttatttgtttaggttgagatttygtgttttagttttggatgttttaygggtttttygtttygggtagyggygtaygggaggagaagattttyg

SEQ ID NO: 11026 - DNA, 865 bp, Artificial Sequence; identical to SEQ ID NO: 11025
  Description of Artificial Sequence: Synthetic polynucleotide

SEQ ID NO: 11027 - DNA, 1463 bp, Artificial Sequence
  Description of Artificial Sequence: Synthetic polynucleotide
tyggggggtygygggaygtttaggaagygaagyggggaaggtttygggygygtygtaggattygygttggagatgggtttgaagttttgttttgaaaaagtyggttyggagtgggttgttttyggtgtttttygagtttttatgttgttatttaagtagtagaggaagaatygggtttggttygggaagggtgggtttagggttaggggtgtaaatttttyggtaaaagtyggtaaattaaaagtygtatatattttaggtttyggtttaggtttyggyggggtagggttttygaagtttyggggygygtagaygtyggggttttygggggttaagggaayggygggattygatttttttgttttyggtttttygggttttygtttttygattagtygttgagtygggggttggggtygtygttttygttygyggttygttgttttttttyggygygygttattyggtygtyggttttttttttygyggggggtttygtttygygtttygttttttygggttgtagtyggtagtttaygtttagggagggtggagggaggaggagaggygyggagaggagggaggggagaggggagggaggaaggygagagaaagggagttgtttttatttyggattttttagagtttgtttggagygygtatttagyggttttygggttttagygttttagtygyggttygygttttttygtttygttttttttttttttttttttttttttttttttttttaggtattttygttttttttttttagyggttgtagtttttagttttaatttttygygtttatttttgggaygygygttttygttttattttttgttttttttttttttttttttttttttttttttttggttttygttttttttttttaggtygttttttyggggttygattgtttyggtgtttygttttyggttygygttttgtttygttttttttttgtattttttgagtygttygtygtygtygtygtagattygtygygggagttttagtttaattygagttygatagttattgtttyggttttagttttagttttatagttygyggygttygttygagggagtttyggygttyggggaaggttttagtgggttagygygttttygtttagtttygygttttagttttgttyggttyggygaggaaggatygggaagatgaataayggyggtaaagtygagaaggagaatatttygagygaggttaatttttaggaggaggaggtattgggyggttyggtgtggtggygggggygaygygggatttagtgygggyggtyggyggggygygggttyggggygyggyggtggaagaaggtttaggtatggttygtgtttyggaygtagttttatagtgtggttyggggagggtggatttygggagygtgtgtttttgtgtttaygygygtttgygggttttaaattgyg

SEQ ID NO: 11028 - DNA, 1437 bp, Artificial Sequence
  Description of Artificial Sequence: Synthetic polynucleotide
tygtaggaatygaggagtyggtyggtttaggtttttaaggttayggggagggggttagggyggaaaaggtagtggagtgagggtgtygttttygggtygtgttaatttygtttygtttygtgtygtygaggyggggttttggttaygtaggaggtgygtttyggaggagggyggygagyggttayggggtggggagtaaggggygygygggyggtaggtatggaayggaygyggygtatttygtttatygygggaygttyggayggyggtyggygygygyggttygtttygagttygagagggyggggagataatgtttgttyggyggggtagtttaggtygtaygttttygttygyggataygggtygtttttattygggygagagggtagyggygggaaggygtygggagygatggttatttyggtttygygaggygyggtaggtttygttygttttttttygygttygtttggygtgygttttattyggtaagtttyggggttatagatttatttttttttttagggygtygtyggagttygygtyggagtyggtgtyggtgttgtygtygtgttygtygttyggttttaggttgtttatggtgygggggagggggyggygggaaggaaygygagggygagygyggygtyggtttygygggaagtgggaaggggygyggggagyggtgygttygygggtgyggagygggtggygggggatttayggggtagtgagaggggtagttttygygtygggttagggttatattaagtttggygggtgyggaaggtggggagggggtgyggygggggaggtagtgggagtyggaggggtygtygttttygtttttttattgygatyggygagtgygttgyggyggyggyggyggyggtagyggyggyggggggygggygtygggggagggggygggygtyggyggyggggggyggggtyggaatyggttttagttggggttyggttagttttttttttygttygtygygyggttttygggggaaygygtagttaatttttatygtttatygtgggttygtttyggtttyggtygyggggygtyggttttyggtygggttttttttttttttttygtttgggttagygttttttttttttttttttttttygygtttttttttayggygagtttttaaattttgatgaattygttyggygaatttttttaaaggggtygygygttgygygttttagttygygggaggtggagtttygtgtttygtatttagygtttyggtttttgggyggttttgttygggyggtttygygtttagggtattygtagygaggttttygggtygtygattttttttgtattttgatttagggttttggggttttygaygtatttattttgtttttaaatttagtygygtagattttagtttygggggatyg

SEQ ID NO: 11029 - DNA, 717 bp, Artificial Sequence
  Description of Artificial Sequence: Synthetic polynucleotide
gyggtaggggygggattyggaggyggggygtttgtttaygtygtttagtagyggagggaggygyggttttagtttygygtttaggagtygtataggygttyggggtygtagtaggagtttttttagggygtttagygttgtatttaygagtygygygtygttttygtttagtgygtttaggagygtyggtagtagygtgtttaygtgtygtatttgttgggattyggggttagttttttgtagatttygtygygatygggttaagtttttttttattttttttttttttttatatttttttgygatttagygygaggtggtttaggtttagtaggtttaattagygtatagtgggttyggggtttttttgttaggtgaggagtygttttaggatgattttttttygtaggagtygtgyggtgggtyggttttgtaatagttaggygaggtatatggggttagtaygttygyggttttygtgtaggtygttgygatttagggattaagtttagggttattttttattatttattygggaagtaggtttatttttgtgaagaaggttatagtygtgagaygttgygggtygttygygttgygaagtygagggagtaagtttgygaagaggtttygtaggtggtggtyggtatgtgttattatagtattggggtgggtggaaatgggagttttygtttygtttggyggttttttttttyg

SEQ ID NO: 11030 - DNA, 1713 bp, Artificial Sequence
  Description of Artificial Sequence: Synthetic polynucleotide
gygttgtagattygggttttttttttagtttaygygtaagtygggttyggtttatatttattatattttttyggttttygtttagygtygttttttttttygggtttttttagtatygatttagtatttattagygtygtttttaggtttttggtttagtttattttygggtaygtgtgagtgtgtgtttgtgttagtttgttagttttatyggggatygggttygtttatygagagagaagygttaatttttgttttagtattatttttagtttttggttttgtttggagatttagtggtttatttygtgtaggyggtagtaygtttttagtattaatttgaagttygttaygaattyggtgatgttttygtattggtygttggygaattttttttttatttgtagtagatatatgttttgttygggttgttgygggaaggygygatygtttyggttttygttgygyggttttttygttattttttttttygyggtggtaaygttttttaagggttgtagaaagggggyggtgaggtttyggtgttttttttgtaggaattygtttaggatgyggtagttttgttgtagttygtaggttagtttttgttttttgtagtaatygttttygattattatygtttttattttttttttttgatygttygygttttttagygaggaggtatttttttygtgggtyggttttgaggtttgggtygtygttgttatttttttttygtygttttttttttyggtygtyggtggyggtygttttttttttttagtyggttttatygttttyggygtttygggtatatttatgtttyggtaggtttaggttgggyggtgtggaatagtygttygaggtgttgggggaygygtgagygygagtygtttttttayggttyggtygyggygygtagttttygttatatygggtttggttttttttagtygtyggttyggttyggtgygygygggggttttgagtttatygtyggyggggyggggttatatggygygygaggaggggggagagaagaggagagtttaggtgttttttttttttttttttttyggyggyggygygygtayggttttygtyggttttattttttygtatttygttygtttgttttttatyggttaggttttgtygggtygtygyggtttyggygttttattttttttygggttagyggggggttgggagggggygaggaggaagggggtttttttttttttttttyggagggggtygtagyggyggtttyggtttttttttttttttatattttttttygtttttttttatttgygggggataygggtagaaggaggyggtgtayggayggggttyggygataattgttagttagaagtttygttgggyggtgaggggggagaaaggggaggggtagggagagaagggggagggtatttagtttttyggttgggaagagttgtggagagaagtaaagaaagaggttttgtygttattttyggtgygtatgygtagtagaataattttttttttttttttygttattatygtgtttygtttygttaygtaaaaggaagagtttyggtttagttataggtttagaagtttgttagggttgygyggattaatgatgtaattaatygtaggttaatygaatatgttgatggagggggaagtaaggygtttgygtagtttaattygttatyg

SEQ ID NO: 11031 - DNA, 699 bp, Artificial Sequence
  Description of Artificial Sequence: Synthetic polynucleotide
gygygttyggaaagtyggtttgggttttgttaattattttgaaggtaaagtatttgtatttttttygtygaggttggttggyggygtygygttggaggggaggaggttygggaggaggaggagaaagagtagygggaggattygggttgggaggggagygtagggttggggaggtygatgagyggttttyggtttttyggagaagtagtygagayggtaaggaggaggygaggttttgtyggggygaggygttgtttttaygygtttyggtygtyggttgygggygyggttgggyggggagtygaggyggtygttttygtattygttygttygttygttggygtttttttttygtttygttygtatttataggtatatattttaygtttttagtagttgtygttyggttttaygtatttatttgtatttttttaaygagttatttgatggttgttagyggygtgggtttygtttyggygggygggggtyggggyggggagaaygyggygygggatgtttygagygttygttggggagagaagyggyggyggyggyggygttgygggygygttagatggggygggaggaggggagattyggtatttatyggtttagagttgtttgaygyggtttgggyggatttygtygttygggtgtttaggtaygattttagggatttagggtaaagyggttygygyg

SEQ ID NO: 11032 - DNA, 1191 bp, Artificial Sequence
  Description of Artificial Sequence: Synthetic polynucleotide
tygatttttattaagyggatggttaagygttattyggaagtgtttattggtgggggygggaaggtatygtagtttaaggtattygygggtagggagygggttagggygtgygygaggtygggggtagttgggaayggaggaggaggggttygttygaggtttygttttttatyggttgyggtttyggttatagttagggtttagagggtttygagtttygggagyggaggtyggagtygggtttttgtagaggttgtttttttttgttttygttyggaygtggttttygttgttygaggtgtagttgtagtagggttyggyggtatatggtttttagttttttaagtygggtttttagggttttggggttgttyggttygttttttyggtygttgtttttagtttttyggttygtgttggtttttttagggattyggygtgttttygygggygtttygttgtygttttygtyggggagtygtaaagtttgayggaagaggttgyggttttygygttttagtygtyggttttygagtygtagtygggygtttttttgaygtagtygygygttttgtyggttttattygtttygygtayggatggtttttaagtggttygtygttaggtyggtaaatygtttttttagttgttgtygggygtygttygygyggtttygttagtttaygtygtygtygtygtygttggggttgtttttattatgagttyggtyggagyggtttggttttyggtygttygtagtatygttttygtygtagtaattttygygtttagtggygttattaygtatgygttatatyggttttattttaatygygtygttagtttygtgggttgaggggtygygyggttaggygygggtaagttyggggttggtagggyggtyggggtgaygayggaggaggagaggaggtygygggyggyggttgttggtttagagttaaaggaggtygggaatttgtttagattgaggygtgttttgttttttgtggtggagttgttttttgggtttgttttttttaggttgygttgatatatagttttttyggggagtgttttgttgtttagtttttyggttgygygggaaaaagygtgtatttttagttgagttgtgttagggygttttygtgtaggtttgggtattgtaggaattagtygttttygttygtttyg

SEQ ID NO: 11033 - DNA, 536 bp, Artificial Sequence
  Description of Artificial Sequence: Synthetic polynucleotide
tygttttttaygtgttygygggggggggyggggtyggtggattgggygtgagttaattggttggggggyggggtattaygggttggtttygtttaggygttygygyggatttygggtggaatgaygggagggagtttyggtagtttttattttttagygatggygtygttgtgtygygtttagtttttagtttgtyggtyggtatttatygttattyggagttygtttagayggtgagatttggggygggttygaggtagyggygggaygttatttgygatygggattatgaggagttgttagattygtggggtyggtaaygagagtagtygyggtatttgttgagaggaaagagggagyggttyggygyggttggggygyggtagaggtttgttygattttyggttatgttattgttttgygtgygyggtgagtgygyggattgaggyggggaggyggggtgtyggygtagaggttttygtatttttttagtggaygttyggtgatygttttatttaaattttatatttygttyg

SEQ ID NO: 11034 - DNA, 728 bp, Artificial Sequence
  Description of Artificial Sequence: Synthetic polynucleotide
tygggygttttattygtygtttatygttttatttttttattttttttattygggttttttaagtttttgatttaggygttagatttttttattatatttttttattttaggygattygttttggtttygggtgtttttagtttgygygggtygtttttagttttyggtggatattygtttttagttygtygttttttgttyggttttgygttttttggaatttttgggtttttagttttygtygtttttagaattgygtttgygtaataatggttatagtggtgagggggttttttygtygagatttggggatggggyggggygtagggaagggaatygtygyggtagtgtttgttygggggttgggttggttttatygggyggggtyggtttatttgtttttttttaygtagtgtaattgattttgttttttgggttagagatggttttgggtttygggygggagtatygggttttgtagttgtatttgtattggggggttgtaggtygttygggttyggagtatattgtggaaggttatygtttttttgtygaggtgagygyggagttggtygagaaggggtaaaggagyggggyggagyggggttagagaygtggtttttttttattttygtgttttttttagatttaygtggtttattttagtatygtttttgttagagttgaygaggttttggggygttygggaggtttggtygtgttggtyg

SEQ ID NO: 11035 - DNA, 1431 bp, Artificial Sequence
  Description of Artificial Sequence: Synthetic polynucleotide
tyggtyggtttttttttttttattttttgatttyggtygttttayggatygtagggattgttttatygtttttttttaygtaattattagagaatttttttaaaaatatagattygatgaggagtggttttttygttttttttttgtgtygagaagggatttyggtygttaataataaagaygtttttygttttttttttttygtyggttygggttygtttttttygygttgyggttttyggtttagygtttttttttygagtygggttgyggygtttttaaatttygaggtygtaygtatttgtatttgagyggttygggtygaagygtygggtagaaggggtygagagagaatygtagtygaygygttgttttttataaggygagattygygtttygggygtygttygatttttttygtttgtagattggttygatagaggagyggggattagggttatagttttyggygtyggggygaagaaggayggyggygttttaggggtttygtttaygttttygagtttygtttygygtyggttttgtttttttataagagttygygttttgttgattaayggtttyggtgyggggygttggagyggtygtygttgttygtyggttgttttygggttttaygtttygygyggtygtggtygtagtygtygtygttatygtttttttttttggtattgtagaygttatttagatttagttaggttttttttttttttaattttgttttttttgtttttttttagtttgttaagygygaggttygtttyggtagygggaggaagattggaggggaayggaggggaygagtataatttttattgagttaggagttggttattgattggaggaaggtgttaaagttgatttyggttttagtttattagygggyggggggagagayggagtttagttttgttttatttttattaattagaggtygttyggtagggtgggaggygttttgagtttaaggagaggttgagttygtttagtaggaggyggggattgyggaaaagaagaattaataggaataaaggtttttygtttttttgatttgatggattatatattygggttaatgggggaatttttatttygaagaaagtgggatttgtttttygggtttgagaaagaggttgygyggagtyggaggggtygaggttgygtygygtggagtggtttggtttaatagtagggagggtagagygatgttttttgattttttagaagagttaygtgggttgatttagagtyggggyggaaaggttgygtttgtttttttygggttattgatagaagygttaatttttgggagtagttygttggttttttttttttttatttttttgtttgttttyggygaggggtggttttgatttyggygatgagtttttagaaaggtaaygtggttyg

SEQ ID NO: 11036 - DNA, 588 bp, Artificial Sequence
  Description of Artificial Sequence: Synthetic polynucleotide
tygtagaataggygyggagttaggtttttggatttgttttgttggaaggagggtygyggagaygtaggygtttygggtygttygygttgtttttgtttgtttygtgygggagtyggggtttttggttttttggttttttggtttttgyggttygggygaatttagagygtattygtaygtyggtttyggtyggtttttagygttygggttttaygggtygygtttttaygyggygttttttagagattttttttttttygggtgggyggygtagyggggtttyggygtygygaggatttttygygttagaataaaggaatgtggggagggggtagggaggagtttaggttattgagtagttttagtataattgtygttyggaggygtttttyggtttygattygaggttttygttygttattattagattygtttttagtttyggattttygtagattttatyggttygtaggagggagyggygtattgggggtygtayggattygttattggagatygygatyggaaggtggygttaygyggtttttataggtttgggatttttattygagttygtaaagtaggtyg

SEQ ID NO: 11037 - DNA, 1203 bp, Artificial Sequence
  Description of Artificial Sequence: Synthetic polynucleotide
aygtttaattttygagtttgtayggtgtagtatygtttattttgggtttagggtaatttgggtgtaaaygtttttgygggyggatygyggggtgggtttygggtatataggaggattagtagtagtyggtyggtaggyggagygttgttagaggtttgggttttataataatttttataggattaaaataaayggygagaygggttgygygtataatagtatattygggyggttagtygagtygggggtttyggttygyggttgygttaagttttagaattatttagtttygtgtttgtygttyggggttyggtttygtttyggtyggygtttatttggyggtgtygttttyggaagattayggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggygaagyggtttyggygttgtygggttaggggtgtygttatygttattgtgygygtttagagtygtataygygttttgaggtagtgaggggttyggtattttttatttttagttygtygggttttttyggtttttttygttyggggygttgttgygayggygayggtygtygttttagaattygtatygtygyggtttygygttttttygtttygyggyggygtttaaygttttygygygygttattygttttygygygattggttgtttttygygaygttygygygttttgaaggtygtagygttagtyggtttttttygtyggggaaaggagtgyggttagggtttggygttygtagttgggtagattttyggtygtttttgaggyggggaygaagggygygattygttgyggttatagygggttaygggttgygggtttygttttgggtttggggagtagattygagtygattaygtttygggttttaggtygttgggaggyggattttagagaagyg

SEQ ID NO: 11038 - DNA, 5370 bp, Artificial Sequence; identical to SEQ ID NO: 6119
  Description of Artificial Sequence: Synthetic polynucleotide

SEQ ID NO: 11039 - DNA, 1691 bp, Artificial Sequence
  Description of Artificial Sequence: Synthetic polynucleotide
gygtgggggagyggggygggtttggtagggaygttggtttttygatygtgggataggggttgggttgggaygygggtttttattaggagtygygggggaggggtagggtyggagtttttattttygtaggggaggggttggttygggaygyggttttttyggggygtaggggyggggtygggtggtaygtygggtttttttttayggtygtgagggaggggtyggyggygggggyggatttttggyggtttttttggttggggttygygygttygyggtagtttttygtggaggttattgttygtgttagtttttttygttgtttygttttttttygttgtygtygtygtygtygtygtgttygttttagygtttttatttygygtttgggagygaggagtygttagygttttygtttygtygtygtygtagygtttttaggtygttattygttatygaaattttttagygttygygtttttttygggattyggyggyggyggggygggggyggttygggggyggygygyggttgtttyggggygtygggtttttttyggtygtygtayggtygggattyggaggttgtyggttggagggaggttyggagygyggtygggygygyggygtygttataagttgygttgttygygaygaggtgagtgygtagggttyggygggtygggygyggggttygtaaatttttgyggggaggygggtttygygttgattttttagggttyggtyggyggttyggggygttygaaygttttattygtttttggaatttttgtaggtgtaggtygttaattgttttygyggygttyggattggggtgyggygygtttttaggagtttgaataatatttygaggtggtygtttttygaagtgtyggygygttttgyggggagagayggaggtyggyggggggtttttttgttttggggagggggaagtggtyggtaagtttagggaagygttyggtttttttttyggtgtttttttgtttgtygatttaggggtttgttgggtaaatttgygttatygygggtttyggggatyggggtggagggyggtggygggattttttygttgttggggagaagagttttatttatattygggaygygggtyggttttttyggattygggtggaagygtagtttygyggagtggggtaagyggygggygaggtggygygggtttygtgtttgtttagtttttgaygygtagaaattgttaaggaagtygggagttttagtttttygtttattttttyggtttgagygtayggttgggttgggggtatttttggttygtygagggtttgtagagygtygttyggggagagygtagatttgttgttgtttttgggttttgayggggygggtggggtgggtttygtagattttgggtttyggttttgttatttagggggattttttttaaygatgggatyggtgttyggagtggagtatggggagtgygttttygggagtyggygttggtyggatatgtgataattgtgggtygttggaggttygtttgygttgggatagggtttggattttaygtgygtygtttgtgtttygttagatyggggtyggggttygttttttgtaaggtttygtgtttttttagttagttgygttggaygttttataaaggtagggattgaygtttattttyg

SEQ ID NO: 11040 - DNA, 1223 bp, Artificial Sequence
  Description of Artificial Sequence: Synthetic polynucleotide
gygttgttayggagatttyggtygtyggagatttygtygtagygaggttattgggtttttyggtygyggggygggagyggygtygatayggggtgttaggaggatttatygggyggaggagggggtttgtttattttttygtatttttttgggtttttttttygggyggtgaygtgaygtgttgayggygggttygtgtyggggagttgggtygttttttgttagtttygagttyggtttttttttttttttttygttygttttattagtyggagttyggtttagtgttttagagaaaggtyggtttgtagtattygttatygtygtyggtygttygtaygttygttyggtgagtttygggtgtygtygyggtygyggggtttagtgygygtatagyggtttggtttyggtttggtyggyggttygtaaggygttttttygygttaggtygggyggygtggygygyggygtygagtaggtttygaggaggtygtagttaggttyggggaggagttyggttgtttygagyggyggyggaggygygtttygtaagygggygggggttgggggagggtygttyggttgtgtyggaggyggtygaggggtttygggtyggtttygyggtygatttggggtatygygtyggggtgaggtttggygaggaggygaaggttgtaggygtgaggtgaaggtygtaggtyggtygggtygattttygttatgtaaatatyggtgagggggggggagggaygggggataagatggyggyggttyggygtttgttgtaggggaygatagagggggttgtygggagggggagtygttattttggaggyggtgtttggagagaaaatttygttatagttygtgagggggggtgggagagygggyggyggyggtagyggygtyggtgaygggtttyggaggttyggygyggyggygtgtgygygyggaggggygtgttygtttttygtggyggttattgtttttgtygttatgatgagygttygggttttaggygttyggyggtagygttatttttttgttttgtttttygtagtttygtgattggttgtagttttygttgygttttagttgagttgtygtaggyggttatygtygtygttyggaygtygggatygttttatttttagygtttttggttttgygttttttttygygtttgtagttattygagggtagtyggggtaggtggtatttyg

SEQ ID NO: 11041 - DNA, 1103 bp, Artificial Sequence
  Description of Artificial Sequence: Synthetic polynucleotide
aygttaygygtygttttgttatyggtgttttttgagtgaygttaaaaygttttggatggtggtattgggattatggatggggtttatttagtttttttyggtttgttattaaggggaggggtygtyggtgggtttttyggygtygttgtaagttatygggtttygaagtyggaggtygaaayggygtgggtttygaagyggggtygttttttagggagtgygtaggttagygaggatttyggtgaggygagaygttatttttatttggttgtttttgttgtttttatttttttagttttagtygtttgtagtgattygtgattttygtaggtttttaaggatygttgygygagggagggggttygaggygttttyggttygtttttttttyggttttyggattygagtyggttttygggaaagagtttgttatygygttttygtagttatttttttygygtgttyggttttttttagtggygggggtaygtgggygygyggggtgygtggtaagtygtttttttttttaygttygttyggtygtttttygygygygygtttygtatatagttttygtgtagtgggtagagttyggtttygygygygtttygtttygtttttggttagtygygttygttttygygtttttgttttttttttttttttttttttygttttttaggygygtattttttttttygygtttttttygygttttatatttatygttyggyggagggggtttagttygtagtygtygtygttatygtygygtttyggtttyggtgtaggtagyggtygtygtygtygagatagttgygygggygagtatttttaygtagtaagttygtttttttttygtttgtgygygygtgtgtgtttttygttygtyggygttttgggtttygggggagyggttgtttttttgtttygtygtygtygtygttyggggttggtttttgyggtttyggttgtttggttttttagggttgggtattgyggtttyggyggtttygttgaggtygggggttaggggtygtttygggttgyggggtgygggaygagggattgygagtgygaggttttttttggtgygtgtttyg

SEQ ID NO: 11042 - DNA, 616 bp, Artificial Sequence
  Description of Artificial Sequence: Synthetic polynucleotide
ayggtagttttygattgaattaattygatagtatttgtggaagtygttggttttgtgtyggggttagatygygtaattaggagygggggttttttaygtggyggaggtttttyggtttgggggttaygggttyggaggaatttgtttggaagttttttattayggtagagttttttggagttygtttygtgttygataaggggagttttagatttgatttttttagtagtttygyggggyggggtygagaaggggygggygggyggaggaygttggygggagaatgtgyggaatgtgttaggygtttttatttattttaggaggggtagaggaaggggtyggtygaggggaggggygaggggygaggtttygggyggtyggagaaaatttgtttgtttttttgygggyggagtttagttygygttttttygtttttttgygygtttttygttgtgtatygygtttygygtttygygtttgttttttyggttyggttyggttyggtygggtgtygtttattygagggagttygygttttgygattgttygattttttattygttttaygagtygggtatyggtgttaggtagggttgtygagtygttattggatgyg

SEQ ID NO: 11043 - DNA, 206 bp, Artificial Sequence
  Description of Artificial Sequence: Synthetic polynucleotide
gyggygggyggttggggaagtagttttgtggtttttyggygggtgaggtygagatagagattaatttttaggyggygttttggygttgagttygygttgaataagattttttygtagttttgygtttygygtygggtgaaggggygtgtttttgtaggygttyggggttyggtttggagttggyggtyggtaygtygtttttggyg

SEQ ID NO: 11044 - DNA, 1141 bp, Artificial Sequence
  Description of Artificial Sequence: Synthetic polynucleotide
tygtagtttgggagygygyggtttyggggatggggagggggtygggaggaggygtgyggttttgggggygygtattgygggagygygyggtggygaggatagggygggtyggggttygyggggygaaggygygyggtgttygggggagggygggtyggggygygygggtyggggygggggygygygggtyggggygggggygygyggggtyggtyggygygygggggyggygggygyggygttgttaatygtagataaaggtygttttagtgaattatgtggtgtygggggaggaagtgyggtttgtttttttttttttagtttyggggttgtaggttgagygygatgygyggagattttygygggggyggyggyggtygtgagtttygatgaggttygagygttttyggtygygyggtagygttttyggttygatggagatttygtygtgggatttagttygtaaygattygttgtygtttaygttgatttyggtygtgtttttttaygtgaagtttggttttatygtygtttatatygtgttttaygygttgtttttygtgtttatttaygtgtagttttggttggtgttgygttatygttataagyggtttagttattagagygtttttttttttttttgttttttttgggtttttttgyggatygtttttttttttttttattttaaagatttygtggyggttaattygtttagttttttygttttttggttgttttattgtttttttgtgtgtttgtagttttttatttttaygttgatgaatttgtattttaygtaggtgagttttagagaggtttttggaggygtttatttggyggggtggttttygyggggygttygaggtaggggygatggtagtygygggggygggttyggttttagggttgagagtgtagggagaaggygtyggttttggggtygttygaattttgttttgtttgygggtatttgttataggaaattttttgttatttttaaaaggggtaaggagaaggtaggggagggttggaggtygtygtttattygttgtttttggtttygtatygtgyggtggattyggggygttttttygtgygtagygygaagtagtagygtttgtataygttagttagtayg

SEQ ID NO: 11045 - DNA, 1819 bp, Artificial Sequence
  Description of Artificial Sequence: Synthetic polynucleotide
gygtygttygtttttggtttttttgatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagygygggygyggygttttagttagygygtagggttygggtttygtygggggygttttttygtygttgtttttygygygattygttgtttattagttattatgtyggatttygyggttaaygygtagttggatgggattatttyggatttygaaggtgggtgttgggttggttgttgyggtygyggaygtgttggagaggattttgygggtgggtttggygygggaygggggtgygttgaggggagaygggagtgygttgaggggagaygggatttttaatttaggygttttttygttgagagygtygygygttttyggtttygtgttygygtygtttaygtgggggattttgttaggggtattygygtagattttgygygtttttataggattttgtgttygttttgygtattgtygtttgggtttttttttttttattgttgtttgtgtttgttaagygatagygattttttygagggttygygaggttgtttyggaattttttaggaygtatagttttattttgggaaatttatyggttttttttttttggtttttttyggyggttttygggtttygtttggattyggtaaygggatagggaggtygttttttattttygattgagtggatagtygygttttgttygggtggatagttttttttttttttaygttagtttyggggtygttaagttgtgtagttygtgggtygggagtatygaayggatatagtttaggtygtggtagggtttagagtgggatgttttatggtttttatttaggtttggggatatttttattygttttttagaatygggtygtgggggatagaaggggtttgygtgygggtagggagagtattttggtttttttttgttttyggggtttataaagtgtgttgggatttgyggggttgttttgtttaagtttgggtttggygttygygtttttgagtttgtgagtgygtgygtttttttgygtttttttgattgtyggtgttggggttttgygttttgygttygyg

SEQ ID NO: 11046 - DNA, 1813 bp, Artificial Sequence
  Description of Artificial Sequence: Synthetic polynucleotide
gygtttagtttygagagtttattatagtttaygtttgggygygtagtattttttygatattgtttttgttgtgttagatagtggtagtgttgagtttaggaataygygyggagttygyggygattttygyggtygtttagttttygyggyggatttyggygygtaggagttattgggtygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggygatggtggaagttttgggttggagggttgggagtttattgagtttygtttaatttgatttatttttttttygtttttygttttttgtattttttttyggttttgtagtyggttggyggggttggygggtttggygttggtggagtggattyg

SEQ ID NO: 11047 - DNA, 1872 bp, Artificial Sequence
  Description of Artificial Sequence: Synthetic polynucleotide
gygttttgttagttaagtygggtagttagggatttayggagtaaagatttaagygggtatggtttygataaagagtgaggttygttttttttttgttgtttygttagttattaaagatgagtgaggyggaaataygayggtggggagygyggggaatggaaaagttagaaggtttygtaataattyggtgttatttgaatgtttgtaaaaygtgtyggtaaaggtagttatgtttttatttygattttggtttagttgttygggataygygttaygyggyggtygttaatatttaggggatagataatagttatattgtattgatagtaygtagataatatyggygaggtgtatatttatatatttaaygataggtttygttattgygaggyggttgttaatttggagggaatagggaaagttagtygggttttagtttttttttttygaagtaygtttatttaaaygtygtagtttgygtttaggttgttttygttttattttaaagattatgttaaygtaggaattgtgggtgygygygggyggttyggyggggagtttttttttttgggtttygtyggttttattttgggagygggagggggaggagggagggttggaggaggggaggggaattttaaattaaaataatttttagttatgaggaygttyggtggtatyggatatttatattagtaatagttatattatattygttttygttagatggyggygggtttaatttttygggatttygtaaatttaggttgtgygttygagygygygtyggagtgtgggtaygygggygggttggggattgygggagyggygyggygyggygygagttyggggygagaaygggggygtggggttggggggygtygggtttatyggtttyggaygaggaggttttygttttyggggagyggtatygggtagtttyggtttagggtgayggtttygyggaagttggggtttagtygggttattattagtttttgtatggtttggggaatggyggagttttggaagtttaggaagtggygggygtaygatatgtttaygatggttygggtttyggtgggtattagtygtagtatggtttgygttttygttygttttttgygtygaygttggtyggggtyggttttygttygggtygttyggttyggttgtgttttgttyggttagggygggygggttygtttttttttyggtyggygttttttttttggtttttttttttttygygtygttygttttygtttttttygttttttyggygtyggygtagttttygtgaattygggygtattatttygggtgtttyggtttggggatygttgtygtttyggtygttgtttttttaatttttttgttttggtttgaatttgttyggygtagattggttaaggatttttttygtttttttttttttttttggygygggagaggtatyggatatttttatttttttygagttttaaaagtyggatttgatttttttygggtaagggtggygggggggayggygggtaaggggggaygggggattygygygtttygyggtygtttgyggtttygagtyggyggtagtttygggygttttyggagttgygyggyggtyggygtaggygtttttttttttygtgygaagygtttatttttttgtaaggtggtaygaattaatttygagygyggttygggyggyggggtaygatyggggatttygggtagggyggggagtttttgtygtygttgtygtaygygtattygtatygatygyggggyggggaaatgtttagtgtttttygttttttaggttggtggttttttgttttyggaattttttgygygtgttttttgtttayg

SEQ ID NO: 11048 - DNA, 652 bp, Artificial Sequence
  Description of Artificial Sequence: Synthetic polynucleotide
tygtagatygtgtatttttgtagggggtttyggatgygatggagttgygygagttgaygttttgggttgggyggtttttaggttygygtygtygggyggggtttyggyggyggygygygygtgygyggttgggggygyggttttgygggttgygygagttggaggtgygygtgagygagttgggtttgggttaygygttygaygagayggtgttgtttygttattgygtaggygtttgygaggttgtygygygygtttaygatttygggttgygaygattgygttagyggyggygtttgyggygggagygggtgygygygtagttttgttgtygttygayggtttaygaggaygaggtgttttttttggaygygtatagtygttattatayggtgtaygagttgtyggygygygagtgygtttgygtgtgattttattttattyggtyggygyggyggttatttttttygtttygayggtattattggtyggtttygygaaagattgygygtgygtagagtaygtyggygyggtttygggattttygygataattgtattgagataaagtgtggtaattygagttggttggtgatttattttyggygaggggttygygtgtgggttaygtygtygtttttatygggaaagyg

SEQ ID NO: 11049 - DNA, 722 bp, Artificial Sequence
  Description of Artificial Sequence: Synthetic polynucleotide
gygtttatttayggygygtgtagggttttaggtttagggagygagyggggygttatgggggtyggagtttgggtttaggtygttttttttttaattttttttgggtttttttatttygyggtttttttyggagygtggtttatygggygtgaagagygygatggttttgaggtagttatattyggtygagtygatttgtaggyggtttagtttgtttatttgtttttggaaggygygtatttggtttatgaaagttayggygygttyggyggttataggygyggygtggaggtyggyggyggttagtagyggygtygtgtgtaggggtagygtygtttgygtygygtttagtaygaagagttygttttagtttaggygtagtagygttatttggtyggttatyggtagttyggggaagaagggygygtggygygtttattttayggtgttgaagagtagtygygtygttagttygtataygttgtygatgtttagtatygygttygtygygtygttttttgygtygaagygttyggtygtygtagggtagggtttagygygtagtagttgygygattagttyggatatyggttgtttygggaagaggttttygtygttygttattgtygttagygtygagttyggggggttgttygaggaggyggttayggtattaggtagygagtgygggatgyggtygygttgtatygttgygggaggyg

SEQ ID NO: 11050 - DNA, 858 bp, Artificial Sequence
  Description of Artificial Sequence: Synthetic polynucleotide
aygattaygttatygtagattagggttataygatagatttygtttttatttatygttttgagttygattaaatagtatttayggtatatattagggttttygttttttatatatatatattataatgaygtygtaaataatagtattaattattatygttygtagttttygygtatagaggttttaggttttyggttttaygtggatygatttygttyggtagygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtygaagaaggaattggagggtygggttgggaaggtttgaagygggtatagtttttaggttggggagggtygaggggagaattyggagtttgagtygggyg

SEQ ID NO: 11051 - DNA, 598 bp, Artificial Sequence
  Description of Artificial Sequence: Synthetic polynucleotide
tygaggtttyggygggttttygtatyggttttagtttttttttygtatttgtttggtyggygggttttatttttttttttgttaggggtagattttgggattatttagttygttttygtaggttttgagygtttgaygtttgygtattgagygygggygggygggtatttttagaaattttyggggygttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgttaaggtaggagtgttygggatgtyggagyggataygygyggagaaagygtygttggggttattygtgtggtygtgttttyg

SEQ ID NO: 11052 - DNA, 1281 bp, Artificial Sequence
  Description of Artificial Sequence: Synthetic polynucleotide
tygaaagtttaaagtttygggtttatyggttagttttttatttygttgttgggtyggataggtgtaggggaggyggattygtttygtagtygatttatttagttttagggtttggtygtatttgagtagygyggttttyggttgttgttggygttgtaggtttygygtttggtttgttagtttgygtagtyggtattyggtygggaagtatttttttagtaggtygtttagtattaygtttaygygtygtatttgyggtygygygggttttggttttaygtagygtttgtagattgtgagttygtagggtagygttatyggtttatgtagtagtygtyggtagygygggtagtygagtaggtygyggggygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygygtyggtatygyg

SEQ ID NO: 11053 - DNA, 1788 bp, Artificial Sequence
  Description of Artificial Sequence: Synthetic polynucleotide
tyggttaggttygtyggtygttttagtttagtattagggygttygygyggttgttaaatattttygggagttttgttygtaaagggattaygaggtagttgttggygygttttgygygtattygtttagaggtttttyggtttgtttttygygggtttgtttygaaattgaygtgaaatygatttggtgtaatgygaatgagttttygttygttttygtttttattttagtygtygtygtygttygtygttataataatyggtttttattttttttattttaygttttgtttttygggtttttygggttataggttatagygygggaaggygtttygttttyggygtttygtattyggtygtygygtattttygttygttyggygttttygagttaygtagaggygttttttttygtyggagaygggaaagtttyggygtttttagattgggtttygtttttagttttyggaggggttggggttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaagattttygagtttaaagagattttyggaaygtaagtggggatyggggaggygagggtggaggtggtygyggtaggggttgtaygggtagttttagttgtygtygtygttattatygyggtagaaatttagtttgttatygygtttttattgtttygttttyggygttgyggagttttttygagygygttygaygygtgggtttgygattttygggtgggygtygttttygggagggggagggggtagygtygggttgttagggagtagtttaygygggygygygattttttattttttttgttatygtygtttttttygttgttttttttttaygygtgattgtgggttgagtatggtggggatggttgtttatyggttgtgtgygtttattygtygtgtgtatgggygtatygygttggygagaygtggttaygagaagattagtttttagtygtttttatttttgtttttatattatgtatttttatggaattggtatttgtaygtaygaggtgtaggtaagattttgggtggttaygygaggatggaagggaagggtttygtagtgtttagggttataygtgggtagagttttatyggagggtttgtgtattttaygygggttyggtygtaygygtyggggagygygtttttaagggagggtttgtgygygtygttgygygggyggtgtttttttygggttgtatyg

SEQ ID NO: 11054 - DNA, 626 bp, Artificial Sequence
  Description of Artificial Sequence: Synthetic polynucleotide
tygttyggtttttygygtagtygtgggatttygaggagggygtttattaggtygygtgtgattatgtaaggtaaatagggggtttatgaagttattgaggattaatggggagttyggagtagagtttggggyggggtttggttttggyggygggygyggattggtaygttgyggatttttttgttgttttataaggyggtgygaggygagttatttttagagggttatataagggggttgaggyggtygttyggyggtygggtagygygagygtaagggatagggagggtygtggygatattygygttagttttygggayggttgggttygggttggtygtygattttygattttttattagatgtttggtagagttyggygygttyggagttygygttttttagagggaaggggtygygygtygtygyggyggttttgaggttgayggtygggaggtgaaaggtyggagtgyggggttaggaygttttttggagggggygyggygtagggggtygyggggaagtygtygagggygyggagygggaaggaaggatagtggttatttygttttygtttgggtayggggtagggattygygygaggyggtgtyggggaggtttttayg

SEQ ID NO: 11055 - DNA, 1037 bp, Artificial Sequence
  Description of Artificial Sequence: Synthetic polynucleotide
aygaagttttygygaattgaattgagagtagataaaagtaygygtttttttttatygttaygtyggttttatttaaattygygagttattygtatttttttttaggagttatagttaggttagaagagtgyggagggayggggttygggaagagtagggaatttttagagttygtagttaaygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggygttggttatgggygagggtatttgtgagaagygtygggaygtygagtatggygttagttyggagtaggttgtaggtaaygyggtttggaataagtagttgggagaaatttggagggtagyggagaagttygaygggyggttggattttayggayggttttaggggyggtagagtygagattttggattaaattaagggggattgttgttagygggaygyggaagttaggttyg

SEQ ID NO: 11056 - DNA, 977 bp, Artificial Sequence
  Description of Artificial Sequence: Synthetic polynucleotide
tyggatttgayggagtaatgtaygtgggtttttgattygtaatatatttagttaaagtyggtttttattgttaagygygttagtagtttatatttattgyggtygyggtttgatgtggtgatgtttatygygyggtttttataatgtagggatttttttgagtggtggtygttttygttttagttttyggttattygtagttttatatygggttattggtttattatygagatagttagygagtttaggyggtttttgtagygttgggagaggaatgtgygygaaattaattagagygaaattagtyggaggagtyggtygaggtgtaggtgtaggygtagtttygtttagaattttttygttatatttaagggagttggaagttygggagggtgttgttttttttttttaggaatagagggttttgaagtgttttttttttagtatatagtygttttyggggatttggatygtayggyggtattataaatttggaggaggtatggaggtaagygttttggyggygtttttattggtaggtggaggtttttttttttttgtgttgtttttagtttygggtatttatttttttatagataggattatattttttagygttyggtttttttgtgtttttaaggtaggagggttagttagyggtygggagggaggagtggtagtagagtygattgtttgyggtyggtttgygaggygtgtaaggttygaggtgtttagtaggtgttatygtagttttagggttgaggtttggggaygataggttttggaggygyggtaggtgtagagygtttyggtagttttagggggtgtgttggaggggaatygtyggtttgtttggatttttygagtattatygaggattttygtygggatttttttataattttaaatyggtttataatttygttagagatgatagggttagggaattagaaatyggyggattagygttagggtyg

SEQ ID NO: 11057 - DNA, 6206 bp, Artificial Sequence
  Description of Artificial Sequence: Synthetic polynucleotide
tygtttttttgyggtaggygaggyggggtgtaggtgtgagtggggtgggaggaaggggaaaggatyggggtygtygtagtttttttggttagtttygttgggttttgttagtttygtttgagatygaggygtayggattagyggtygttagtattttataggtggaggatattttttgygttttaaggttaatgttatttygatgggtttygtgtygttttgattttttttgatttaattttttggttatgatttttttattttttgggtttygtttttgttagttttygtygaygtygtttttttygtygttygttygggtttttttattygtttttttttttttttggttygayggttttattgaggtaaaaataaatagttttgagggtattttaaggagygtgtagtggtttygayggtattttyggggggataaaagaggtggttagttaygtygtyggttttyggtygaataatgggygygtagtagattgttagggggtatttgaaattygaggggagggaaatatttgagygyggttttttttygygaggaygtaygaygtagtttygyggatygttttttgttygtttttttttatgtattttttttttgtgtggaattatttaaaygggagatttttggtagttttatgttaatgygtygaataaaggtaayggttygygggygggaggttyggaaggtgtttggggtygggtygggyggggtggyggttaggygggttgygygtgtttttygygtgtttttgggattgatataataattttttatttttgtaaatataaagttttttatyggttygggtygggygtattyggygtagggaggygttggttttttygggyggygggtattgtagyggtaaygtayggtttttgtyggttgtggttygggggattgagggtygggagtgggggtttttgtgaagttagaagagaagtttgtagtagagtggtgatgaggggygttgatattttatttttaaygtygaygtttttaaaygygatattttttgyggggtgagaatgygggttygttyggtttttttygtgaggttagggttttttgtttttttagatattttaaggagttaattttttygtagaagtttttygtttttgtttttatttttaagtttygygttttttataaattttttgttgttttgattttgatttttagtygtggtgagggttagagtgaatttyggygygtttttygayggtattttygtatattaggataggagaaattggagggtttggggtttygggtttygtagtygtyggaggaagaatttatygyggggttygtaagggaaagtgaagaggttygggatttttttaaagygttggttaggatttygaaggaaggggaggagttatttgaagtyggggaaggttttttgggtgttttgttttggatttttatgtttattgattttygygaagtttttttggaggggggtaaattygygttgttttttttaatttaattttaygyggtttatttttygaatygygtgygttaaggtyggygtygggggygtattgtgatggygttttgttttttttaggygaagataaatatttygattygatgtttttatgtatgygggtgtataggttttgagaaaattaygtagaaggyggttgygatttayggttygggttgggttatatttgtttggaggtygttggtgtgtgygtgygygygtgygtagtttaattttttttagtttygggtggtgaaattagtttttaatattagtattttttaagtttttatttattttgattgtattygtttgaaagtagattttatttaygttagtaagattggaagttataaataaagaaaaagaaayggatttattgaattttagtattttagtagygtttaatagatttttttggttaaatttagagttttgtttgaatttatttaygtaggagttgttttgttttttttgttggtagaggtgtyggttttttatttttayggtttatttataattatgggtgttgttatttttaaaggatttataaggtgattaattttttgttatttgttgaatggaaggagtgttatatatgtaagatygaatggggtaggtygagttttygttttatgttattttataatttagatgggattygtgattagaaaataaaattggttaaagttgtttyggaattttttttttatttttaattttattagtattattaattagagtttaaaagagtaaggaaataatattagttatttttagatagaaatatgtttataaattttagataaatttattttaagatttttaatttttggggagattagtatttattatagtatttttaaaattagggtgagattttttaaaatatattttattatatgtatttttttttttttagtgtgtgagttaaaatattataaatataaaattattaaatattttttttttgattaattaatttgattaattttttaattaattaagtttaataattgtttttattataatttatgatttatgtggattttatttttatatgtttaatttttaygttagggtatttttagagggaaaatttaaaataattaaatatttttagtggaattaagygtaagtaaaatttagtaaaatttgtttggtatataaagttttgtagaaaaatgttttttttttttttaataaagtgatattttttttatagtatatgatattttatgtggtttggttatttgttttttagtgttggaygattagggttattaygtattygtggggttttttgttttgtttttygaagattttgttttttgtgttttttyggggttgggttggatagaggatggaggtaggyggtttagtttgggtttaaayggaayggtagtggaggtgggggtgggggtgggggyggggggaattttygttgttgtttttttttggtggtataggggaggyggtttgttttttyggaggttttagtttgttttagagtatagattgtttttttttttttygtttagtaygygttttttttgygtttagattggtygygatyggagtttaatagtaggaggttaattttttttataaaggtgaagggggtayggtttygtgggggttgygtttagataggtagtttttttatttygtagygttttgattggagtttttgatttagtatttgatgttaatyggtaaataaaatgttygttyggaatgaaaatgtatgaggtygygyggggaggagaaagttaattttattggggygtaygaggtygatygygygtttygggtttyggttaattygattyggattaatygagttttggattaygyggaagtttygggyggtttgggtygggtttygttaaagatgttatttttaagtttttaagaatttaaaagtttagaaatttaygtttttttgggaatttagtttagttygttygygttttaatttygygttttygggagattgagaaggtygtgttaatttttttttaaattygaaagaaattttttttagtttygtgggygygyggaggttgygagtataaatatygttttyggttattgttagaaggtygggttttttgtttatatttggaatttyggggaatttttttgtttggttttttgggtttagyggtttattygtttaaggttygggyggaggtygttyggattttgttgttttttyggatttttgtttattttttaaatattaygyggagttattgygttttygtaaygatttttttygtatygtttyggygygttttygtttttatttaattagygygtataatttttttttyggtttyggttygyggattgaatttttttgatatatttggggttattttttttttttgttgttattttgttagygattygygggtaattttygygygggaggggggygtgtattgtygygttgatggaygggtttatttggyggtttygygtttttyggaggagagatataaagtttaggtaygtgygtttttttatagagaagtagtagatygtgaagggaggyggggtygggygtgtgtttggatygggyggggyggyggygtygggyggggygattaggggygygygygggggtttygygtttttaggtatatttgtygtatttatygggygattttygagtttyggtttttttttggtygttttatygtttttttattttgttaggttgaggagttgyggaygygttgattggttttaggggaagygggaggygagaataatggtttttttttttygttaaaagggagyggttgtygggttyggggatagggaygygygtgtagggygtagagttgggtygagtygtygtyggygttaygygagtttygtagtygtygygttygggtaatgggtygggggtattgagggtygtyggggtygagygyggaggggggatygagttagtgtygtgttttygggtygygttaatatgtttygyggttttttggtgaagygtagtaagaagtttaygttygttttttatygggttygyggyggygaggayggygatygygtattgttgttttygtttagttgygggggygttygygtygagttttyggygtygagttyggttttygggtygttgtygtygtygtygttygyggagygygtttatgtagygttygtygtygygtttgtttgygygtttgggtygtagttattttygtagggttygygggtygygtatttyggtaatttygaggttgygtatttygygtygttttatagttttaygyggttygtgagtygygagtaygagaagtataagtatttygaaygtagttttaatttgggttygtyggtttyggtygagtttttttttaygttygtygygttgttyggagggggyggyggyggyggygygagyggagttggyggaggyggtatttgyggyggygattygttgtttttygygttygtygagtttaagatgggtayggygttttyggttggygtygaggyggttygyggttygggtttyggttttttattgttttttgtygtygttttgyggttttygggaaagyggttttygttttttatygtygyggagtygttygttaaggtagttaaggtttygggygttaagaagtttaaggttattygtaagttgtatttygaggaygaggtgattaygtygttygtgttggggtttaagattaaggagggttyggtggaggygtygyggggtygygyggggggygyggygyggtygttgggygagtttatttgttagttgtgtaaggaggagtaygtygattygttygygttggygtagtataaatgttygygtatygtgygtgtggagtatygttgtttygagtgygttaaggtttttagttgttyggttaatttggtttygtatygtygttggtataaatygyggttygygttygtygtygttygygygtyggagttagaagtagtagttagggttgaggygygggaggtattyggyggyggtagygatygggataygtygagtttyggyggygtgttygagtygggtttygaggaygggttttaygagtgttattattgygttaagaagtttygtygttaggtttatttaygtaagtatttgttggygtattattaggygttgtaggttaagggygygtygttagygttttyggtygaggatttattggttttgtatttygggttygaygagaaggygttttaggaggyggtyggygayggygagggggtyggygtgttgggtttgagtgygttygtygagtgttatttgtgtttagtgtgyggagagtygttygttagtaagggygtttaggagygttatttgygtttgttgtaygtygtttaggtgtttttttgtaagtattgttyggttattttttatagttygttyggttttaygyggtatattaataagtgttatttattygaaaatagataggtgatttttttgtaggtgttygtgygttyggtttgttagagygygttttttatttyggttttygaattgtgttttygtttggagatttataaagagagtgygttttgtatttttygaattygagttygygttgggggagtttygttttygtttttatygggtgaaagtgtygttttygtttttttyggtgtggygtgayg

SEQ ID NO: 11058 - DNA, 574 bp, Artificial Sequence
  Description of Artificial Sequence: Synthetic polynucleotide
gygtttttttttttgttygygttttyggttttttygttggtttttgttygagtttttagtttttttgtattataggtttttggggtttygtttyggattyggttattttttaggttyggagtagtygtygtggaggtygttttttygygtttaggggaagggaaggyggtttyggggttygttgyggggtggagggattygygttttttagtttttygggttygggtygyggggatygtgygygygtttttttttygggtaaggtygggyggygggygygtygyggtttttggggttttygtttttttgttygttatygtttgygggagtttttggtttggaggggttyggggygygttggygattgygggttyggygataggggyggttggtggygggaggatagtgggaggaaggtttygttttaygygtttttttttyggatgtgattygtyggggtttttygtagtyggggygagyggtttggaagttyggaggaggggtayggaattgttygatggggatgygatygygggygttagaygaattgtttttatattygttggygttggyg

SEQ ID NO: 11059 - DNA, 3438 bp, Artificial Sequence
  Description of Artificial Sequence: Synthetic polynucleotide
tygttggtggagttygtttttttgaagtyggagttggygagtttttygtatttgattttgtaggygtttttttygygggttagtygggatattttttgtttaagttgttttatttgttgaatgagttgygtttttttattttttaggtggtgtttttgttggaygygtttatatttgtaagattgggygtagtttyggttttttagggttygtygtttttgttttaggyggattatttygtttttggtgaagtttygtaggtggyggtttagttygygtayggatatggataygagttggtygtyggagaagyggttttttaygttgtygttgtygttygtygtygtygtygaggtygtygygtgyggttygggttyggggtggttagtgggtagttgttgygtygggttagyggygttggayggyggyggygaygtttggtgatgatggtgatggtgygggtgagygtgygggtttagttygtygtgggttaygtyggygttygggtaygtgtggtgygggtgagggtggtggtgatggtggtggtggtgagygtygygaaagttgtygaagttttgtagyggttgtggtattgggtgygagtygatgagygtttttatygygttttygggygttaggttgagygtttyggggtttatttgttggtagttgttygttatttagtatagattttygaggtgtgttttttgttyggtygggttgaagttgggygaygagggtayggagttatayggagtgttgagyggtgtggaggatatygagtyggttggttgtaggygtgtgtagggtttgttyggaygtttygygygttttagtggttttttttttaygtygaatttgagtaggtygaagtygttgatatattttatggttagygggttggtgggtagttttggttttatgtttagtttygyggttatygttgaagygaggygtagtygtygttgtygttygggaaattttgyggtyggtyggagygygtygagttaagygygggggggaagagyggagaagagttggggaggyggggagygagggygtagygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtygygatygttyggtttayggtyggaaggtttggayggygtttygtatttagttaggttttttttatttggtttaatttaagttagtttagaaygtatattatgtgtgtattagagtttaggataggtttttttygagygatgtataggttttygggtttygttttygtatttagtygygagtttygagtygygagtttygttttggtygtttygttgaaatttygtgttttagygttygggggtgttygtyggttgttttttgggtyggaaggttttgggyggaggaaggtyggtagttaaaagtggaagygttatagtgaagyggtttagggttatygggtgagaaattttttyggagggtagayggggagatygaagtatatygtattaggtatttagattgggtttgggagtygygtattttttttatttagatttaggatggttagaattaaygggttttttttgagatttyggtttaggygtygaaatyggatagatygygaattygttggattyggagattygattygtttttygygttatttttttttttttagttttgggygygygtagygaaaggtaggagaggygygtattgggtgagtgagtttyggtygttgtttgygttggattagttygattgatttygygygtaggggtygygtgagttatatyggtgtagaygygtttagattatttttaaatgttagaaggtaaaatatttgtttttaattaatttgaaaattttttatttttttgygttttyggagaggttggggtayggygtggtattgggtygtttatttttaataaaatgagtgtattttaattaaaatttaatttaattttgtggggtggtaaattaaatgttggaagagygygtttataatttttttygagaagygtgtttttygtagaaatgagtyggtygtttggagagagagtttgggyggtgtygttgygtagtttttgttagtagttgggggttggggattygtattttgtaaatgttttygttttgtttgaaygtagtgagagtatattygtttttagattattygggatygggtgtttyggatttgtgtagattatgtatggtttyggttttaggyggttagggygggataagtayg

SEQ ID NO: 11060 - DNA, 4088 bp, Artificial Sequence
  Description of Artificial Sequence: Synthetic polynucleotide
aygtttygagtatygattttatagttayggttatygtttttyggttttygtgatatyggygygtttgttgtttygagtaggggaggttttgtatttttatygtatttttttygttygaagataygaaatttygttygggygtygtaaataattygaattyggttttttgatatttatttyggygggygygygtygttgggagggyggggtgggtggttggaggtaaggaggygtatagtaggggtaagygtygtygtygtatattttgtaygtygtttagggttatattatttatygaaaattgggaggtaggtttgggaggyggggttgagygtttatygttttgggygygttygygtttttygttatygyggttttygygttttyggtttaygttygygyggtttyggtatyggtttgtatttttagggtgygyggyggtttatttgggtgygttttyggtgggtygatttttygygtttttttttyggtttataggggtygttgttatgggtyggttttttgaagaggttggggygttatyggggtyggttagaagttttgtttttyggyggggatatttagtygygtyggtatygyggagygggttgygttaggtggttggtyggygyggygtttttttgttttttggtttygggttgyggygyggyggttggagygagtttttgtttyggygyggggyggyggygggyggtyggtaggygttgttttgygtgtgagtgtattttatttatatgtaagtyggggagygtyggggtttttygyggaagtgygagtygttyggygtaggtaagagtygtygggttygggataaggtaggggygttygggygtygttgttttgtttyggggygttttygggtattttttaattttttttttttttttttttttattggygtgtttaagagttaaattaaggagygtttgagggtaaatagatttttgttattygygtttttgtatttttttttttgagttgatattttttggtgttttttggtttttygttgttgttgggtgttttttggtttgtttttgtttttttttygtttgtttattttttttggygttaatttttaggtagttagtttagtagttygaagttygggtagtygygtttygyggtttyggggtagygyggygggaatygtagttaagtttttygatayggggygtaygggggtygggtagttygaggtygggggtaagtagggagttygggttaggygygagtygagtttttygaggtggtygggttattatgttgaagatggttatgaagtttaaagttygggyggyggagagygagaagaagayggtygyggyggttgtygaggtggttgtygaagttgyggyggyggttgyggygttggtygagtygagagagtygttygygtygyggaagagyggggatttygagaagttygygaagaattttaagaattyggygygggaggygtttttygaaaagtttttaatagataaggagygtaagaagttygagaagaagttgttggagtagaggygaaaggaggagaagaagaaggagaaggagaggaagaagatggagaagatgttgaagaagaagaagaagaaggtgttagaagtttaggaggaggttygatgtttygaggtygtygtygtygyggtygtygtygaygaygatgagggygtygaggagggygtygtygggggygtygaggagggygtygtygtygggggtaygagtagggtttgggttgattgggatayggattygagygaygaggaygaygtttattaygyggygtygygygttgggggtatygtgtggyggttygggtygtttaaggttggygygttgagygtttatttgtttttygtggtgtttttggttttttyggtgygtagtttttygtgggtgtttaattttttgttgtagaagygtayggagtagggtygyggttgyggtttygtgttyggggygatttgttgttttygagtgtttttgggttgygttttttttttttatttgggyggtygygttaagygtagaggtygygggygtttyggggttagaggygttttyggttygggttatggygttyggygtygggggygygaggagyggtttatttagttagattttttatttygttatygttattagatattattatygttgtgtagtgtgggtttttattygtgttygtgtgtgtgtgtggatatattttttttttyggttgttttgttttttggttygtgttygtttygttttttttatatttttgttttttggttttttgtgtttttygttttttygaaaatttttttaagttygggygygygtttttttttttttygtttattttagtttttyggyggygttygygggagggggaggaggtttygggggygtygggygaygyggttyggggggtggagygttggygtygtgygaggggtygttattggygyggagaygtttttttttttttttyggtttagtygggttgttgttygagttyggggggtggggggygttttttyggttygtttygttttyggtygggygygggyggagggatttttttttygggttttyggggggtygttttttttygtyggttttygtttttttagtygtygtygtygtygyggtygtttttyggtttttttttttttttttttttttttatttttttygtygtygtygttttttttttttttygttttttttygttygtygyggygtttttggttyggggyggyggygggggttyggtygaggtaataagagyggyggyggyggtagyggyggtagtagttttygtagtttttgttttggttygtttyggttyggyggyggttattagttttttyggtttyggttygaggggyggggagttgygygygtttttyggttygatygatattttttttttttygttygttygygygtttygyggttygyggttygtagttygtttygygygttttttgtygaggagtygagttygygttyggttygttygttyggygttgtttyggttttttyggtttgygtgaggtygttygygttygtygtygtygtagttyggtygygtttygtygtygtygtygtygttatgggttgtttygggaatagtaagatygaggattagygtaaygaggagaaggygtagygtgaggttaataaaaagatygagaagtagttgtagaaggataagtaggtttatygggttaygtatygtttgttgttgttgggtaagggygggyggggggygtyggtttyggttygggggttttygaagggygtttygtaggtygygygygtygagttygtttttygtttygggygygygttttygagtttttygttygttygygggttttgtttgtggggggygaggtyggaagggggatttaggggygyggattyggtygggygggggtttaaaaayggggyggggggtygtggygaygygggygygggtttttttttttyggtttgttygtttagtgttttttttttgttttygttttygtttttttttttttttttttttttttttttttttygygaggtttataygaygttaggggtttgggtgygtgttggggagggggagggggagtttatggggtttyggagattgygataaaaagagggtttyggggataggaaatygggtggygggtagagggagggggattygttttygtggggtgtgagatttgttgggagagggaaagaggggaagaaaggggygaggagaggagggggtgaygttggggggygtygtggtggyggagggggtttygttaaagggaggttttggyggggagaagtggtygaggagagtgggggggttggtgatattagtttttyggaaaggatyggagyggtaaaggtggtgtagtgggggggagggggygtaagggagtygtggygtyggagtygggaggggggyggygaggggaggagggagggyggttgtygttgggygygatttggtgygtttygggtaggatygattgattgtgtgtgygyggagtagaygtgtttygggttaggtygggtyg

SEQ ID NO: 11061 - DNA, 522 bp, Artificial Sequence
  Description of Artificial Sequence: Synthetic polynucleotide
tyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtygtgtttgtgttaggttttttaygttgtgttttagggttttagtgttyggygygtygggggttgtatyg

SEQ ID NO: 11062 - DNA, 2260 bp, Artificial Sequence
  Description of Artificial Sequence: Synthetic polynucleotide
aygttttyggaaagttttttttaatgggaagygatttygtygttgagttaagygttygaattttttttttygyggtagggatatyggttygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyggtygygtygyggtaggaggtgtgggaggtagygaggggaagtygaggtaaatttggtggygtgggagattttayggggtttggggaattttagggtaagatygygggtttgagggggaygagggggygyggtttayggagttggggaaaatgaygaagtygggaaaygagaatatagtgtttygttttttttygttttttttgttaaaaaaaaaaaaaaaaaggtgtgggagagygatagttgggaaggtaggttagatagaaataggtaaaaaaaggtagtgatyggagtygagtttgttggattttaggggtygattaggggagggaggtgttyggggayggggagggaggagggttgtygggatgtgaatyggggaaggtagttggggttggagagtagygyggaaagggggtttagggagttggaaagagggttaagaggagggtaaggaaggtggygggygayggggagaggaaagaaaaagggtgttttggyggtggttttggtaagagaaaggggtaaggggtataattgataaggtattgaaagtattgaagttagagttttgggaaggatttatygaattttyggyggtttaygyggggatagattttagttygtgagttttgagttttaygyggggatagattttagttygtgagttttgagttttaygyggggatagattttagttygtgagttttgagttttaygyggggatagattttagttygtgagttttgagttttaygyggggatagattttagttygtgagttttgagttttaygyggggatagattttagttygtgagttttgagtttagaaggagtggtagttttaggaygtttgttaggtggtttggaatgtgagggaagttttagtttygttaggaatagagttggygttgagttttyggttyggttygggttagaagygaggaaagtttgtyggygagtgttttttgtgttgygtggagaggggtgtgggyggtygtygattyggygttttttygtygttygtttagggagtttttgtttggtaagttggggttyggggaaaagtttagtagygagagggtygygtgtttygggayggttttaggggagttygygyggaaaygyggattaggygtttyggttyggatgtyg

SEQ ID NO: 11063 - DNA, 1502 bp, Artificial Sequence
  Description of Artificial Sequence: Synthetic polynucleotide
tygygggayggagatagggagttgggaggaaaygtaaygygttttttaggtaatagatttygagtttyggttyggaaaygtttygaggtagaagtaagggtttttaagggtttygttttttagttttgggtttttattattattttttttttagattyggtgagtttaggttgatggatygtgtagtttagtttgagttagtttagtagtttttaatygggygggtagggaagaaggttttttattgtygggaagaggttagygygttttaagtttttygtaaatttygtttttttygtttggtayggtttttttgtatygttgtgtttygtttttaggtttttgttygttaagaatgtttgtttygggggygygttygttggttaggaatttgtyggtagttttygggaatttttgaggatgyggaggtgggttygagagttgyggtttygatgtyggggtgggagttaggtaggtygygygtygtygtagttttgtygtagygygtgttttggttttttyggatygaaaaggtygaagtygtttttygygatygatttygygtaattggttygggtttgtatttagatggttgtgggttttatagggatggtygggygggttygttyggtygttattttagggtygttagttttygygygyggtygtttttygttaggaagggtggygggttyggaaggttagagatgttttagtgtttttygygtygttaygtatttagttgttygygggttttatatggttgyggtyggagggttygtattaggatygtygtygtttggggaagygtttttttgtgggtagggygyggygggtagtgyggaagttygaaagttatyggagttyggggtaggggyggygygatgtagaggyggygttygggggtttttagttgtttgyggttyggttatttagtygygattagagggggygggggaygtaggaatttyggygttygggyggtgtgtagtygtagatttattttaagtttttaygtagttgygagagtttaaaaattgttaygtgtaygtygttgttgagtgggaggaggtgtttgttatygygtttaaaaggggygtttyggtgtttttygttatgtaagtaaatggtatggttttyggtygtttttgaataaaygagtgtttygaattttttattaggagggattaggygtataattattttygatatttttygggtatgygagaattyggttttttttagtggggtttattaatgttgttygggaggtaaagaaagtgatyggttaayggttttagygtgggttttttttttttttygtttttttttttaataaaggaygtayggagaataagttttttagtttttatagatgaggagtttaggagtygggygaatattaagtatttattgtgtgtttgtttttttattttggggaggttgggggttygggagtgaagggggtagygagatygygggttgttttaygtttatygtyg

SEQ ID NO: 11064 - DNA, 510 bp, Artificial Sequence
  Description of Artificial Sequence: Synthetic polynucleotide
gyggtyggttttggaagaggtgggggygaggggtygggggtttataygttttgygatttttttttatgagaatgggygggggtagtttygggaagggtggyggatggagtygttttttttttaggattataggggygttttttagtgaaggygtygtaggaaaygttagtttgtgtygtagtgtaygtagaggygttatgagttygagttttttaygtttagggataaattgggagtygtgattgttaggtygygyggaggttgttttggtygtttttgyggttaggtgaaggygtagaggtagggaggtygggygagygtaggygggyggagagtagattaygyggaagaggtygagagagaaagyggggtattyggtygggggggttatttataagggaygttgggtaygaaggaggttggggygaagatgagtttaggggttgggttgagagygttgygtagtygggttgagaagagaagttgaygagtgattttygataagggayg

SEQ ID NO: 11065 - DNA, 940 bp, Artificial Sequence
  Description of Artificial Sequence: Synthetic polynucleotide
tyggggygtaggtaggaggtattggaagyggaagygagtggggagttygggtagagggagtygtttatttgatyggtttygtttttttyggggtttgttgtagttgagggtttyggattagygattttagaagtyggttyggggtygggtagtttaatagtttttygyggattttttttygttggygygtagtagyggygygtggattygygygygggttygggayggygygagttygggtagygygagtttttgygyggtagggagtggygtatgygygggygttttgygagttygttggggygagtygagtygyggyggygtygggagtygggyggyggagttgtgaagaagtaagyggyggtaygggagtagyggygayggataggtggygagttttygttygygtygttaggggttgttgggttattygyggagtttygyggtttagaygtggygggggtggyggyggtatttyggayggtttgtgagggatgygtygtttattgtttygygtygtttgatygttttygtttygattygyggtgygttatagtygggttygyggtygttttygtygygttgtygttyggtygtygygttygyggggtygygttyggtayggttatgtggatttttayggaggaggagaaatayggygtaggtaggtgaggtttaggtttggtygtggygggggttttgggggaygygtttagttttyggtttygtttggattygtattttygtgttttygttattgttygtaggttgygyggtttyggygtggggygagygyggggtgggggtaggtgygggtgygggtgygggtgygggggtgggygygggtttttgtgtagagagggyggtagggggygttggyggtgyggttttggtaggtgyggttygygggaggggtgggtaaggttygggtagttgttyg

SEQ ID NO: 11066 - DNA, 2718 bp, Artificial Sequence
  Description of Artificial Sequence: Synthetic polynucleotide
tygtygttagttatgatttatgttttagtagygttgggaagtgggtygagggaattgaggtyggggtgggtgyggaggtggttttgayggggagygtygatttaggatttggttyggattttgagttyggtaggatttgtgygtaygtaggtagygtygygtttttttttaggttgygagaggttgttttgttattaggttatggatttygagtygttygtgttgygygygygygtgtgygygttttygtttgygtttatgtttgygtygggggaggygaaggaggttttagttttagaaagagtagtttttggaatttattatttaggtyggtygtygttyggtttygtttygtaggttgtaggyggttttggagggggygttttygtygagygygygtttygygtygtygtttyggattttttttyggygtygygygggtaggttygattaggyggtygygggtttyggttttyggttagttttttagggttygyggttygtttygtttygygygttygtttygttgygtaattygatttaagttggaagtygatygtaggyggtygtattygygtttagygtagggyggyggyggyggyggyggygtagtttyggygagygaggyggyggtygtayggttaagygtggatygyggggggygttygygttygggagtagtyggaggattygyggyggygtyggygtttygttygggaaagtaaagttggagayggagggagygygygggygygggggttyggaggagyggyggtyggygtttyggygygtygagttttagtyggtyggatgggaggyggagygttygggtygtygtygtttgtygtttgygtttyggttgggtttygggatygyggggtygtttaggtaygttygttygggygtygygtygtygtgggttygaygtyggggygtttttygtgagtygggtygagggyggggtygygygaggatttygggatttgttttttttttttygtagtygygtygtygttygtttygggygttttttgttttgtatttataygttyggtagttgyggggagttyggtagttaygtttttyggygygtygttygyggagttattayggtygagggtyggttgttgggygtygyggttttyggygggygygttygagtagtaggyggygatgygggygtygatttyggttggggggygttygagttgtygyggttgygtttyggttttaggagggayggygtagttygygggaggattatggygttttyggygttggyggyggygttggyggtggyggtagyggygggttttaatgygagyggygygggygagaggggtagyggyggggttgttaatgtttygggggttttttgggggtygtygygyggttagtattyggygggygyggtggtagggttggttgtygtggtgggtttttttatygtttttatygtggtgggtaaygtgttggtggtgatygtygtgttgattagtygggygttgygygygttatagaatttttttttggtgtygttggtttyggtygatattttggtggttaygttggttatgtttttttygttggttaaygagtttatggtttattggtatttygggtaggtgtggtgyggygtgtatttggygttygatgtgttgttttgtatttygtygatygtgtatttgtgtgttattagtttggatygttattggtyggtgaygtaggtygtygagtataatttgaagygtatattaygtygygttaaggttattatygtggtygtgtggtttatttyggtygttatttttttttygtygttggtttygttttatygttagttygayggygtygtttattygtagtgyggttttaaygaygagatttggtatattttgtttttttgtatyggtttttttttygygttttgttttattatgggtttggtttaygygygtatttatygagtggttaagttgygtaygygtaygtttagygagaagygygttttygtgggtttygayggtgygttttygattatygaaaaygggttgggygyggyggtaggygtaggygagaaygggtattgygygttttygttygtygaygtggagtyggaygagagtagygtagyggtygagaggyggyggygtyggggygygttgyggtggggygggyggyggygagygggygyggaggggggygygggyggtgyggaygggtagggggyggggtygggggyggttgagtygggggygttgatygtttttaggttttyggggttyggtggtygtttgtygygygttagttygygtttygtygagttttttttgtygygtyggygtygggygygtagtagygtgtgtygtygtaaggtggtttaggygygygagaagygttttatttttgtgttggttgtggttatgggygtgttygtgttttgttggtttttttttttttttagttatagtttgtayggtatttgtygygaggtttgttaggtgttyggttygttttttaagttttttttttggatyggttattgtaatagttygtttaattyggttatttatayggtttttaattaggattttyggygattttttaagtatattttttttygayggaggagaaggggttttaggtagtgattygtattygtttgggaattttggatagtttygygttyggggttgggtagaaggggyggttyggayg

SEQ ID NO: 11067 - DNA, 2661 bp, Artificial Sequence
  Description of Artificial Sequence: Synthetic polynucleotide
gygyggttttgtttygygttttttttagttagtatttaygtgtttttatttattttatttaggttattagttttatygttygtagygggttagaagattygataaagygttttttattttgtaggattagtgttyggttttygttgttttttygttttttttttgygtagatttaaggtttgattyggttttaaattttaaataaaagttgtgggtttgtttttaagtgatggyggttggagaaaattagagttgggggyggtatagttagggtgtatttttgyggtgggtyggttyggygtatttatagtttttagttgttagtttaggygttggggtygtagggattgaatttygtatygttttygtagttygggtgygygttttatyggtyggtttgtttttygyggttyggtttatyggtggtagggayggtttygtttgttttagtttaygttygttttttttttttttygtttgtggttttgttygtttttatttaagtttttggtggtttaaygtatttttgtagagatatttattaagagatagygtgtgtattttgtttttygttttayggaagaatttattagtagygttatttagttttattygttttaaagtayggtattttttagtttaataaaaagatygaaggygaaatattgtgggtttttgttygygaattaatygtttagttatygaattttttaaattgatttatttggaataagttattttgtttttttattttttattttatatatatatatatatatatatatatatatatatatatatatattgyggatygggggtttagttaygtatatattttaaaataaaygagggatttattygggatttttagtygggyggtygggygttttygttttttttttttttttttgagttttttagggattygttaygtttttyggaattggggtagyggttygtttatttygtgttygttgttggtygggatgattttagattygtttattaaggaagatttgatgttagttaaatygttttttttttygggatgattgatttyggygaagattttttttttttgaggatygttttygtttttgaaggggattatttygttygtggygtagagtttygggtttttttygtygtygttatttttttyggagagttggggtatttyggyggttttgtaattttygtttygttgtgggagtattygygtaatagtaggaaagatagaggggtaatttaagggtgggggaggaaaggagagttggaagggttygtgtagtaggatagygggyggaagyggggygggygagygyggggtygtyggtyggtagtyggagtagttgtygyggygttygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygygttttgtttygtaggtgagyggttgygtttttttattgtttttttttttttygygtttygtyggygttgaaaagttatttatttgygtygtttttttttttttttttttttttygtttttagttttttttggttgttygttggaggggaggyggggggtgagggggagtyggygagaaggaggtggtgattgagggtttttttttttttttttttttttagattttgtaggaygagttttggttttggggtgtgtgagtgtggtgtgtgygygygygtttggagggaaggattaggtaatttggygagagaaggaaggatygggygttgtttataatttatygaaaggtaygttttgttygyg

SEQ ID NO: 11068 - DNA, 801 bp, Artificial Sequence
  Description of Artificial Sequence: Synthetic polynucleotide
gygaggaaaattgaygttttattttttyggattttgttygagaagttgggggattygggttyggtgtygaggtgtggttygagtttggtattatttaygtyggtygggtgatttyggttttttggggttttygygtttygttagtaggygaygttgggaggttggggtaggtttagagygaggaygggttyggattgggtagtggggatgtattagggtygggtgyggygggagayggttygggaggyggaaggtygyggatttgttygatagaagagtagatgaggggagatygaggaygttygggttyggggagtttaygaggaggttaggatygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttygttygggttttttaagttgttagtygygttygttttygggtttttygttttttttttygygygtttttttttttagyggtygtyggatttttttagtttattttttttagttaaygygtttttyggaygttgttagtttgagygtataggtattgggyggggtttaygggggagtygtttaataatyg

SEQ ID NO: 11069 - DNA, 311 bp, Artificial Sequence
  Description of Artificial Sequence: Synthetic polynucleotide
tyggttttygtttyggtggttttaggtttygggttttgtttggyggttttgtttttaatgyggagttggyggttttgtagtaaygtttttgttagtagygtttattgagyggttttttagttgttgtatygtttttagygtttaayggaaygtttttygtaygyggagtttataagttgtttgtgtygttattttttyggttttggtatygttagtattttttaggaattttttaaattygttttayggtgtagaayggtaattgtatygagtttttgtgttaattagtattttygtaatatygttagtyg

SEQ ID NO: 11070 - DNA, 1048 bp, Artificial Sequence
  Description of Artificial Sequence: Synthetic polynucleotide
aygggagtaggtygggttgtttaygayggaagtttygattttggttggggttgtyggtygggtagygygggagagttagggttagagtyggggtygggaattttagtttygtygtttaygygggatgtagygattatygttygtygttttygggtyggtatttattttygtggaggggtagyggygttagtatttggtygyggatttyggttttgggggagttaagttygtagygttygyggtygatgygaaaygtgagyggggygtygyggtygggtttttgtatygttaygttgatgagygtygtgtagtatttttggttygygttgtttgttygtgtyggttataggttgtaggttagtagggygagygyggygagtygggtagggttygttygtttygygtagtttatygttttttyggtagtygtygttgttygyggatygggtttyggggtyggygtttagaggyggggygggygyggttygggyggyggygggagygygygygygyggtttgygyggggtygagttygagygyggtttttttggaygtygyggtttygtygttygtygtttttaygtttattgttygtttgtggggaygygtttatgggttttyggygagggyggygttttaggtygtaygygggygttttttyggggttttaggagggttgtagaagygtgttttttttattttttygggtyggttttatygaatgggaggygtttygtaaggaygyggygggggaggggaagggyggtaygggaggaagygtttygaggagggttagyggaatataaagtttttttygygyggttgtygtttgaggygygtgttygtygtygtttygttttttygttggtttagyggtaaygygtaggtttaaggygtagtttygtttygagygtatgygtgttagggtttgttygttttygttygtttgtaygagggttygggtagtygggttagtygttggtgttggttgtttttttgttaggygtgatagtygtagggygtggagttygggagatttgygaggayg

SEQ ID NO: 11071 - DNA, 301 bp, Artificial Sequence
  Description of Artificial Sequence: Synthetic polynucleotide
gygaaattygttttygtttygaagaagggttttaagaaggtygtgattaaggygtagaagaaggayggtaagaagygtaagygtagtygtaaggagagttatttygtataygtgtataaggtgttgaaataggtttatttygatatyggtattttttttaaagttatggggattatgaatttttttgttaaygatattttygagygtatygtyggygaggtttttygtttggygtattataataagygttygattattatttttagggagatttagayggtygtgygtttgttgtttttyg

SEQ ID NO: 11072 - DNA, 1395 bp, Artificial Sequence
  Description of Artificial Sequence: Synthetic polynucleotide
gygaatygatttgtatttttttgtttattaggaagyggtygtygtygtygtaattgttggygttgatygygtaygattggaaagttgtaattttatggttygaggggtaggttygggttgagtaggttttygagtygttattgttaagtatggggtattttaggaaggagtttatttttgtattgtttatttgttattgagtgatttggttttgygaagttyggygtgattgtgttaatttttttattttttttatggggtyggagaagaaaaatgatatgaatgtatagtgygtaagagggggggygggagggyggaggaygttggaggaggggtaygtgayggtgttagttaatggttgagttttttgtaaaagtttgtyggttttygtagtgatggattatygttttagtggtatttaaattttyggygtttygtygtttaggtgaygygtagtygtttttttaggtagtttaggyggyggtagttgttgyggygattgtaaaggtygatttggagtgttggagygaagaagagtaaaagttgygttttgygygygttygatttygttgttygtttygttaggttttygggaggtgggggttgggaggygtttttygttttygttttttttttatygtttaatgaaagatgaattggygagaggtgagaagggaagagggttttyggttttttyggggygggaattagtgggttagagttygtygggtggtygtaagtaygtyggtttagttygtagygygtttagtyggaaggyggggaattyggttgatatygygtttygggtttttaggttattttttttgttttgaggttgggttgggagatygtggggttgtgaggagygtatagaatygtggtggagggygaggttgggttatyggttttttaagttyggaatggagggggaagagygtagagggttggttgggaggaattygggtgggygtgaaggagaygagggtaagaaaagaaatttttttttttttaggagggttttygaaattttttttttatagtttttttygttattagtatggtaatgaggagtttttgtaattygatttggaggggyggatgagttttggaaatttagagttygtyggaaaaggtygggggyggtygggttttttttttttattttttttttttygtygtttttygttttttttttttttttatttagttttgtatygggagtttttygggatgyggagttattygatygtyggatttttaggggtaggaggygggggagagagatgaygttggyggaygtggttagygygggggtygggyggtgygttgtaggttatttgtyggygttttgagatttaggagttttygygttttygygtgggttttatagggtyg

SEQ ID NO: 11073 - DNA, 766 bp, Artificial Sequence
  Description of Artificial Sequence: Synthetic polynucleotide
tygggtttttttygttgtggttygtttgtatttttgagttggtatttgtttttygggyggttagaygttygtttggtttttttttyggtttyggtttttttttygyggygttttaatggttttygtttttygygtagggttaygattgtttttyggtgttgtttatttatgaygtygtygyggggatgttgagtttyggygggyggttggaygtttttaagtagagttygtagygtggtttgayggttygygagygtttttagaatttggataagaaggygagtttygagggtggtayggttgygggygygggtttagattygttgtataagaatagygttaggtgagagygggagtygggtyggygggtgggyggggtttyggttygtttagaaatagygtygggtgaggaaggggtttggagttttttttttggggtattgtgttgggattttgaggattggggattyggagggagggtaggygtgtttttaattygttgygtyggaayggygtttgatgagyggygggttyggataygaggggayggggtygatttgtgggyggggttttggygtygtattaaaatygygtggggyggaggtyggtagaggtygygtagygggtttagggtagggagtggttttgattygttgyggaataatatygttagttgtgggyggggtttattttgattttattatagtagtttaggtgttagtggagtttgggagggatayggtgygatygatataagayggggtyg

SEQ ID NO: 11074 - DNA, 691 bp, Artificial Sequence
  Description of Artificial Sequence: Synthetic polynucleotide
gyggtaaagaggtyggatayggaatygttygttyggtgatygaagagayggygaggaggagttygygaattygtttttgtttaggtttygtttattygaygtaatttgttygtttttttttatttttygaagggtggagtttgaggtttygtttttaagyggttttttttyggagtgtttggyggttagtagggyggggtaggaggttgggagagggaygggtgygggggtgggggagaggaagggagyggttaygtgtgaggggyggttygaggttaygtgayggagygtyggagyggagggagtyggggttgggagtttttttgagggaagaggagtggagtaggggggaygyggyggyggygttgataatggtgagtgygyggyggttagygygttygtttttygttttygtttyggagygygyggygggtyggttaatygygggtygggygtygtyggaggaggggaygggggagtagggyggggagyggggttaggtttgtygggttatttttgggtttgggaaaagttggyggygttattttttttyggtttyggygaggttygagtatttaygggyggyggygtgtttttttggttatgtyggagtttttgttygygtttttygattgtttgttggggttttggttggggattyggatttygtttttgygggggttggtygtyg

SEQ ID NO: 11075 - DNA, 1024 bp, Artificial Sequence
  Description of Artificial Sequence: Synthetic polynucleotide
tygggagggygtagygttygggtggggagttygagttagtttaggtyggttttggttttttgatttagatagygtagggygygagggatygygyggtygagttygggtygygtygtttttagtatyggggtygttagttaagagttygaggttttttygattyggatgtgatgaaaaagagtaatagagggagaagtgttttaggattgtaggagtggaagaggggaaagagaggtagagagggggaaggttttttygtaggggagtyggttggagtgagttggttggaaagagggggyggagtgygyggagttagagtygttatygttgtygtagttgtygttattgyggygtttgggttgagtyggagggaggygggaggaygygtaggggyggtygtygtygtygttaggttatyggggygaaaatgyggtygttgtyggaggttygttaatttttyggggtggaagaggaggaggaggaggaggaaggggtttggagygattayggggggatgyggaggtaggtagtggttttygggyggggaagaggaggggtttgatttttattttyggggtttttttaaattygatttttttttttagttttttttygttgggtttatttyggatttttgggatttygtygttgttaatttgygttgtaatagtttttttygtaagttttaaattaaaattttttyggggtggagtttgagggagggaagtggagggggagggaaygtttygtaggggtggtgtgtttttttttaaaaatatttttttttttaattttgtatattttttygttagaagtagttagttttttgtatttagtattttatagtttttttttygtgygttttgtygggyggygagttaggyggtagyggygyggygygggttyggyggagyggtttatgttyggygygggygaagttttygttttygggttygtggggtygtagygygtggtygaggygggyggyggttagttgggttttatagtttagggtgagtgygyg

SEQ ID NO: 11076 - DNA, 1339 bp, Artificial Sequence
  Description of Artificial Sequence: Synthetic polynucleotide
tygtttttagygtttttaggtttatttttygtagatttttttygggtygtttttttttgttttattttaggygttttttttttttygtagttatatygtggttgtattygtygttttttttttyggtygttattatttyggttttttagaattttagtttttygygttygtagtygygtttttgttttttygattttygtatttttatttggttyggttttttygtttttttttyggtttttttttttaggatatttgtgtygttttattttttttattatataygtattttttattttaattttttygtttttttgttttttttttttygtyggtttttttttttygttgttgtttygagagttygatgtgggagggaaggygygggggaggggaggtygygaagggggttgttttttttygggtttttygtgttgyggaattgtagggttttttagygttttttgtttttttygtyggyggygyggaagtyggggtttttyggaygttttygatgagggtatttatttttttgtyggggatattttgtagayggttttaatattggtaaatattatagagaattgatttygttyggtygtygtyggtttttatttttygggtttttygtttttygttttygttygttttygttygttttttyggygttttygtygygttttttygygttygygtygygygttttygtttgygtagtygttttygygttttagtaygttyggtyggygygygygttyggtatyggttttatttttatttygtttttygttggttygygattaagygyggttattgttygygaygtagttttygttttttggyggttgtygggttttagtagttgtaggttttgyggggttagyggyggygagttgggtttttgggygagggttattttyggggggtttgggtaygygggygagygattgygtaaggagygygttyggttygtagttttttygttttyggygygatttttygttttttygtttgttaagggtgggtttggggtagttttttttatatttgtaattyggtaattttttttttygttygattgatygtttgttttttttggttygtattttgtgttttgatttttygttygtattttttttaggtttttyggttgtttttttgtgttgtgtaggggaygygygattatttygygtttgtttyggtygtygttgtgtaaygtayggtttagyggattttgtatttttttagaygggggagggggyggggaggaggttgttttatygtttygtttagtaaatattagggattygtgattatttgttygttaagattygyggyg

SEQ ID NO: 11077 - DNA, 2273 bp, Artificial Sequence
  Description of Artificial Sequence: Synthetic polynucleotide
aygyggtggtattggtggttgtyggtagttgtygtttgtagagtgggtgagatygagtgtggtagatggtttggttygyggtgttggaggggattggyggagtagaagygttttggygtygggtttttgtttttttggagttggggtttggggaatggggtyggttattgtagggatagaggagagggtagggtaatgggtgygtaggggttttttttaaaggttgygggtggttaggggtgtgygggggygttgaggtgyggtygtygagagattttggtttttagggtggtygggtttggtatggattttaggggatggtgtatatatyggatyggaygggttttttttttattttyggatttttyggttgggtagyggttagggagaggggygatttaygggggygggtgtggggaygtyggattaygygttaggagttttagatgggtttagatttttatttttygtttygggtygtagtgaygttagggttyggaygttttyggaayggttttttgggggygttttagttttayggattygtagggagttttygtygtaatttgtatggggtttatttgtatgatttygtttygygygggagtygggggygtyggygattggaggagttattgttaatttttaggggaaagtgggygaggygatttttgggtygtttattttattttattttttagttygygtygtatttggggtttttttttatttaygtttygttagggyggggtygygggygtagatattygygggtataygtaygaygaygygtataygyggtygtaygyggtttttygagttttttgyggygatttygatttattttygygggtgyggggygyggattygttyggtttagtttttgttttttaggygtttttttttttygygatttgtttyggtygtattygttttygttttagtaygygaygttgttyggygygatttttgttttttyggtttagttttatygttgttttygatttaattttagttgaaygttygtagttttagttttattttyggtttagttttagygtttttagttttattttyggttttagttttagttttagygtttttaggtttagttttagttttatttttagttttaatatttttaggtttattttyggttttagttttagttattttagttttagtttyggtttagttttagttttagygttttyggtttygggtttagttttagttttagttttagttgagtattttyggtttygtttgttyggygtttttttttgtgyggygttttttygttygtattygttygattttttggaatttttygyggaygtyggggtttttggaggyggttttttttgtttttgttttygtttttttttygyggygttttygttttttatttatttttttagtttygyggggaygaggggagttggagggagttygggattyggygyggttttygtaggyggygtttttttttygttttygaygyggtygttttttttgtttgttygtttttatygtygttttygtttttgtyggggayggggatagtagattttyggygttyggttttygygtatttgtygygygtatygttttttyggtttgygyggtttygggggtttygggaagatygagygttggyggttagttyggggaggttgtgggtagtaggggtggttgygggtttttagtttttttttygtttatttyggagtttatatttgggatttttatttygggagaattttgttttttttttaygatgagtttggaggattggagtygggatttggtatttttagggttgtgattgggtgaattttgagggtatagttgttgttygtygttttaggggttttaggatggggygagtagttttgaagaggtttaagggtatttygtgaggagtttttaygttttgagagtggggygtagagtyggagtttygggttatgttttygttgtygttggygygggatattyggtagtygtttggygtttttttgttggtgygaggttttatggtgttttgtaaygtttgtttgattttgttggttatygttaygttyggtttygyggtgttgttgttttttaataattgtaggtggtygygggyggggygtygtattggttaagttttaatttygaggtttttgtatatagaggttggaggtygyggygggttygyggggttttyggtagtttttyggggatgggatgggttattttgyggatttttyggtttttggaggtyg

SEQ ID NO: 11078 - DNA, 5586 bp, Artificial Sequence
  Description of Artificial Sequence: Synthetic polynucleotide
gygtyggttgttggggttgttaggtgttaggagaygtttttttygggtttgtttyggygttygtttttatyggygtttgttttgtygtttagttataggtttygggttttttyggtagygyggagttgayggtgggygyggyggtygtttgttttttggygttggagggygtygaygtgagttatattaattatygyggtyggagttygttggatttggtygtygagggtygygtgtttaaggttttttagggttgygtttagygttttyggtgagttygtggayggyggggatggggttyggyggttttygggttttttttaagtygttttttttttttgtagggagyggtaggygggygggggygyggtttygggttttaggtaaaygttygggatttttaatatygtgaygaatttgtaygtgggygtygygtyggggttygaggtygttgagtgtttggtgtgtttygagttggygttgttggtgttgttttygtygtgttagtatygtatygtgtgtgagggtgagtggggggtttyggggtggggaggttyggttagtagggtygtagttaatygygttttttttttygtagagtgygygygtaggatgaagaagtgtattaggtgttaggtggtygttagtaagaaattgygtttaggtgggtgaggttttgygtttttaataygttttttgtttagttggtggttygygggttttygttttttatttttttttttttatattttygtttatggtttttttttaggttatatttygtttttttaaggtttatattyggttttttagtttttagtttttagttttgtttgttttagattatattyggtttatagtttygttttaaggtaatattttttttttttattatattttagtttygttggattttayggttttttttagattatattttttttatagttttattttagattatagtttatttagagtatygtttttttattatatttyggtttagtttatagtttatttgtagttttgattttagttygtatattattttatgtttgatttttayggtttattttttgttygtattygggttttatttttgtttttaaattatttatttygttagttttttttgtaggttataattygttttaggtgatatttygtttttagtttygttttttygtagttttttgtttttygtatttttttattyggttttttagtttatattygttttttatttygtagayggttttgaggtggygagygtygttttygttttyggttygtygygttagttggtggaggagttgtagagtygttatyggtagatggaggaaygtattatttgttttatttgtatygatagttatattygtttygtgttttagtgyggttayggygtatgygttttttgyggtttygygtttagygtttgttttatttgtygttagtttattygygatygtatttagattttygtgtgagtygygtygttygtygygttygagttgttttygygtgttttygttttgtgttttataaaaagaaagattttyggaygttgtttttgttgtttgtttgggggatygggygtttttggggtttttttttygggataygygggygagtttgggggygaggagggggggtttttttttgggttygtttygttygttttaggttttygggtttagattttygttyggattgyggttttygggttaggatattttttaggygygggtayggtygtttttygttttttaggttygggttygayggggyggggatttttgtgtttgttttygggtttttttygttttttygttttgggggyggtygyggggattygygttttgatttaaggggttygatattttttagggttgtggggtttygttttagtagggagttagttggggggygttttaggtagggtttgggggtygggygtaygtaggyggggtgaygagttgggggggyggggggyggtgtyggagtaaatayggyggttaggtttagtttttygygttttttaagaatygttygyggtygtygttagttgtttggygttgatttygttggtygggttgtygttattttgggttygaygtyggygyggaaaayggggagggaygagatagatataggtyggtttggttyggaattttttgtttttttgtttaattttttattttygtttygygggaygtyggtgttyggtttyggttttagtttagagtygttygygtttggaygtyggtygtttygtygaatttttgggttttygagtttttygttttygtttttaattaggatyggtttagatttttaggttyggygtttagtttygtttttygtttttttygttttttttttttttttgttggggtttagtyggggatttaggagttatatattttttattttaygygttattttttayggggtttttygtagttagggttygttttttttyggtttttygggagattttggtaagtttttttttttygtttygtaatttggtatttttygyggtttttgtttatttaygtatttttttttygtttttttttttatygttttatatttattgttaygtttttattyggttatttttttttagttttyggggatattgttaggygagygaygygttttttgyggtttagtttagttgtttgggttaggatggagatttygtttatgtggggtttaggggttttttgaggattttatttgggaaaaaagttattagattatttattgtttagtagtgggggtttggggatttttattgttatttttttttaagygggagttttggygttgtttttttygggttgtttggggtttttttygttttttttttygaggatttygtttagtaggttatgtttaggtttttgtttttggtttaygggaygygggtttttatgttttyggttggagatagtaggtagttyggttaayggaygggttagttggttttttttaggggtagttttgttttttttttygtttygttttttttttttttattatatygggttgtaattygagtygtygagttattgtttttttttyggatttttttyggaggttttgyggttygggttttygygttttgttgttttatgtagttttgagttttatagtaagtttgttatgggtygyggggttygtgttttttyggaggtttygggggtaggygtygagygtygttggtttggagtygygttggtygttttgtgtttttttttygygttggtgttgttggttyggttgggggtttyggyggtgtyggtttggagygtagygtaggtgagyggygggggggaggttaggtgtygggttgggggggtttttaygtttgtgggtttggtttatyggggggttygtaggaygtgtgyggggtgtgyggggtgtttgagggttyggatgtgygtttygaggtyggagggttggaygtttttgtgtttagttgttgggaggggtgggaggtttygttttgttgtttagtttttttttttttattgggtygygtttttagggaygtgtaatagggygtttaggttaggagattygaaattataggtagataggattygttaygttygtttttagttttgggtatttttattttygtttttttttagtttatttttygyggtagtttttggttttggggatygttatygatgttttttaygtaygtttttttttttgaagggagaygtygttgygttgggtttttyggyggttttttttattygggtttygggtttattggtttttygtagaygtygttataygttgattttagttaggttgygttgggattattttaattttatttataggtgygttttggttgggtttygggggagggggygyggtyggygttygttgagtttattttttttgtaggattttttttttttygyggaatttgttgagttygygggagaygyggygggttttagttgtygtttttygtatgtggagygaygtgtttttttttagttttygygaggtggttttygagtagtttagygattttyggataggtgggygttygttttygtttyggttyggttttgygygttyggttttttagtttygtgttttttttaggtttttattygattaattatayggattgtttggttttygygttgtattattgtttygayggttttaygggggagttggtttaygttttttttttttygtayggyggtatttatttygaygatagygagtattgggttttgggttttaygygttatagttggaagaaaggtgatygtttaggttggttttttggaggttttttttttgtagtatagtgggttgtygyggtygggttttggggtagayggtaggagggatttttyggggtggtggttgttattggagtttagtaggtaaggaggggagttygtgggagtttttatttyggtagttttgaatttttttttttatttttttgygtttttggagygggagttggagttgtatttttgggggtygagtttatygtttgggtttagaatatttttattttttygtggttgyggtygagggyggtttygyggttgygttttagtagatatatygggtttyggggagttggtttaygggyggyggggttgggttyggggtttttaggygttgattttyggggttygtaggygtgtggtttayggatttggtgtaygtggyggtttaygagatyggttaygygttgggtttgatgtatttataatayggtygggygtttatgtatttgaaygttaygttgygyggttggaaggygttgttttaggaygagttgtgggggttgtatyggttttayggtgagtttttttgtygggygggagggyggggatygggyggttttgagttaggtygtgttttttaygttttygataggatgtttygataggttgttygtgtgygygttttgggygyggaggggtttttgygaygttygtyggyggtttatgaagaggttttgttttagtagttgygatttttgttayggtgatgtttayggggtygggatagggttgygtgggagttgggttttggttatggtyggggttgagggggtattgayggggtttttttttttattyggagtagaattttttttttttayggtggttattattttatygttttttaggattaaaattaggttggtgttygagggtaggaaygtgatttttygttgyggttagaagattttttataagaaagggaaagtgtagtgagtgagygtttygggyggttttyggggtgggtagttygygggyggttttggggtaggggtgyggggtaggtagyggggggggttgtgtttgtaggagaygtttygtttttttgtagttggtataaggattaggagtttttggagtttttttatttyggttatttggttttgggygaggygtatttgagtattatygttaaygtygttaatgagggtatttatatttgygtggtgygtygttagtagygygtgttgattatttatttttggygagttygtgtgyggggttgagttyg

SEQ ID NO: 11079 - DNA, 1264 bp, Artificial Sequence
  Description of Artificial Sequence: Synthetic polynucleotide
gygyggttygggygtagtttyggygtagttttygygtygagyggtttygygtttygtattagtttttgttyggtttygggtgaygtygtatttttygattggattaygyggtttggggggyggggtttggttyggtgagtttatygtygygtttygttattggttygggyggygtattygggtagtggyggggagatygyggtattyggagtttygygagtygttttagttgyggygagtggagttgagygggygyggggtygggttgggtygggtygggyggggtygggyggggygygggagttagtgagyggyggttyggygtaagtttgaygagtaggagtygagtttagtaggttygggtaggtgygyggyggygyggggttaggyggagggygygtgyggtygagggyggyggttggygggggygygygyggggygggggyggggtyggggygtggggataygygtgttygygggtygggggygtggtgygyggttaygygtgtttttggygygagtgtgyggggttaggtygggagggygtgygyggatygggygtgtttaygygyggtagggaggggttaygagggtgygygygtttttggygygagtgggaagtgtggggattyggygggttyggtgtgaggggygtgtttttggggygagagtggggagtgagtgtgaggagtaagggtgaggggttgtagggaggggtgygtttggtygaggagtgggtgggagataygygtgtttatgtygygagggtgtgtygaygttygagtttgygtggggttyggggtygtgtgtttggagtggtygagggygtgaggggygygygtgtttgtgygaggggygtgtgyggygggtgtgagttaygygtgtttgggtgygygygygggtyggatgagtttttggagtggtgygaggaygygygygtgtgtttgtgttggagygagggyggggaygagygtgtygggygygygygggyggggttggggyggygtyggggygygygggggttyggttyggtyggyggygagtgtgttggggygttyggtttttttttaataygggtttttgggatttagtgtygtttttttttygyggyggggttygyggagttttyggtttttttgggtagataggtgygaggygaggtgygggtatagttttgygttttttagygggtgygggatygggygaygggggattgtttttaattatagattaggggagyggagggaygttygatttattygyg

SEQ ID NO: 11080 - DNA, 716 bp, Artificial Sequence
  Description of Artificial Sequence: Synthetic polynucleotide
tygttttygyggggygggaatttygygtttttttttttygagttttattttttatggtaaagyggygtggggyggyggggyggagggagtygagggggyggggagggyggaygggyggaggggaygggaggtttagyggtttygggtttygttggttygggygtyggatyggagtygtyggggygygggyggtttaggtaagygggtygggtgggtgggggtygygttttttygtttttgttttyggtgtatataggtgatagygtyggtagtgttyggtyggagtttgttyggtygttagtygggattttyggygyggygtttttggaggggtttgygggtggggggtgyggtttttaygttttttgygttttagttttttggttttttttttyggagtyggggagtyggtaggttyggggygagggtttagtgaggtyggyggagggtygagttttagttygggagygggagtyggggattyggygygtagggyggaagttttygtataaaaggtyggagtttygtatatggatygaattaaagtttyggyggygtttagyggtgatttyggyggtygttttgttyggttgtttgyggagggtttygygttttyggagttygggggygttttaggtttttttttttagttagggttaggtaaggggagggaygggtttyggggttgtttttttttgggttttaygygttygtyg

SEQ ID NO: 11081 - DNA, 619 bp, Artificial Sequence
  Description of Artificial Sequence: Synthetic polynucleotide
tygttygggattyggggggaggygygttgggtggttyggtagtygggggygggyggtagtttgtaggygtaattggtatgtaygtygttgtagttgagatygtttaataaagtattatatattttatygtttttatattttattattttaygyggagtttgtgagagggttttaatgggagttagttgtgtttttattttttgttgtyggtygggaygggtttttttgyggattttttgaaatgaaataatgtgatgtaygtygygataagggtyggtttgtaatgaggtttaggtygtygggyggttgttattgttttaggtgtygygtatttgggttgygaggataaggaggaggagggggyggygtyggaggatygggggggagggggaagtygygaggggtagggggtgggagaaggyggagggaggaggtagggggtagggggygggyggaagaggggaggaaggagggggyggygggtygyggtaggttaggygggagaagtyggagatagagagaggayggggatagtggyggtttgtagagttttaggaattygggtttaaattttgttygttagygtgagagagygtttgttygtttaggyggtttatyg

SEQ ID NO: 11082 - DNA, 293 bp, Artificial Sequence
  Description of Artificial Sequence: Synthetic polynucleotide
gyggtttyggtaggggttgttgyggygatttaggttgttgyggttttagttttattagttgttgttgttttttaaggagaygtygtygatagyggagtagtggttgttgttgttgygggggyggtagttagaggttttagygttttaataatyggagtttaggatgttgtttyggttgttgagaggttygtaatttttagygttgygttagagaaattygtttagtttagagygggttygtttygttgyggtttttaygyggggttgggtttyggagtttgtttygtaaagyg

SEQ ID NO: 11083 - DNA, 2748 bp, Artificial Sequence
  Description of Artificial Sequence: Synthetic polynucleotide
ayggtagggggttttygtgtttttygagaatttaagaattygtttygtttttaygyggaaagttgggagaaaaattgttttttttttatttttttttattttttatttattygtttttggagtttygttygtagatatttttttttttygagttagaaatagatatattattttttttttattttttttttygtgygtatattygtttttttttttttgtttgtttttygtttttttttttttttttttttttgttyggagttgtagtttgtagtttygattygggttggttggttggttgagtgyggtyggggygttgttyggtagtgyggtgtttaygggattgataggtaggtaggtygygggttgggattyggatattaaagtaaaagtatygttgggygtyggaggagtygyggggtttttattttttttttgattgatttttaaattttaatttgtatttttttygtygtttygttttttttttttygatttygttttatygtttttyggtttttttgtttttttttttttttyggttttttttttygygttttttttttttgygttttyggtttgttttttttttttttttttygtttttttttttttttttttttttttttttyggtttttttygttttttttttttttttttttttttttygttttttttttttgygttttygttttttgtttttttttttygtgtttgtagaygygyggatygtttatgygtttttygygggtagaatgttgggtagtagygttaagagygtgtagttygaggtggagttgagtagyggyggyggygaygagggygyggaygaatygyggggygtyggtaggaaggyggtagyggyggayggtagaggtatgttgtttaagygygttaaggygttyggyggyggyggyggtatggttaaggttagygyggttgagttgaaggtttttaagttyggtagygtggatagtygtgttttyggygggtygttygtttttaatttgygtaagtagaagttatttattaatttttttttttttayggatttygagaaaaagttgtagttttatgagttygaatggagygaygatatggttaaggygtttaaaggtttaggtaaggtggggtttaagggtygtgaagtttygttgatgtttaagaygttgtttaagtyggagtattygtttttttaggttaagggtagttyggygggyggygttaagatttttttggtttygttygygtttaatttgggaaagtygagtyggatttttygaggattttatgyggaggttaagtygtttagtaaggygtttgaagyggtygtgagygaagatggtaaatyggaygaygagttgttttttagtaaggttaaggygtaaaagagttttgggtttgttttttttgttaagggttaggaggagygygttttttttaaggtggatttygagttggtggtgatygtgttgggagatttggagtagttgttttttagttagatgttgggtaagttttgtygtttygtttygtttygtttttggtttttttttaattagttgttggggaaggtgtggggaaagygaagttttttttttttgygttttttyggagggtttttttgtttaygattaggttgtgatgggtattgygtttagatgtgttgagttggtttatttttagatgygtatggtttaagtgtatttttttaaagatattataggygggaattygggttygattttggtttgttygaggtgaggttggataatgggatggggggtgagggggttataggtttttagaaatagagttagaattttaatatggtaaaatttgggattggtggaaattttygttgtggtgtggtttgygtttgataggagtatttygtattgtaaggggagygtttagygagagttyggatttagaggatagatgtgggagagtagatgtgagggttgattggtttyggaatatagttgaggttttattttttttgtggatttygagtgggagygtaagtyggattttttygyggtgtgaggattttggttaaaagaagygtttagggtygggggygggygggttgttagttgtgygtatttgggygtatgttygatattttagtttyggttttggttttaatttttatattygtaggttttttagggygtgtygaaagttttgggygttagygtygagatttttgtttgatygggaagtttttgttttgtggttaatggaagtygagtaggygggaagggaggaataaagtttgttygagtggaggaagygygtagagttgttttattgtttttygtgtttgaagagtttatgtaaaaaaattygaagygggtttyggaattgtttttttttttttyggagagtttttgtttttagagaggaatagatttgggatgtgtyggaygttaggyggttatgtttygggaattggtaygggtttttttggggttayggaataaggayggtggggtttggtgtttaggygagttgttttggttgygyggatttgttgyggtggttgggttgtgggtttttyggygtygagggattygagttttttgggtattyggtaggttgttygttygttgggggttgggaaggggygtgttaatgygygtgtgaaagggyggggtygagtgaygggtttggygggtggggaatatgtaagagttygtygggyggttttggagaatgygaagtyggaggagatyggttyg

SEQ ID NO: 11084 - DNA, 433 bp, Artificial Sequence
  Description of Artificial Sequence: Synthetic polynucleotide
tygtttyggygtttttatygtygtygtygtygtttaatagagtttttggggyggtttttatygayggtgtagttygtygggatygggaggaagtagttgyggttatygygtygtgygttygygttyggtygttaggtgttttagtagttygatygtygagatgtttagttygtyggggtttygggygttatggttttgygtygygttgtgygtttttyggagggtyggyggygttttttagttyggttyggggtttatygtttgttyggttttttgttattgttaggaggayggtattatgttgtttgtygattgttttgagttygggttgttygtygtttygggggatttggattttttgayggtttatttgtgagtattgttygtttgttttygtttggttttgygggttgttggttagygtttagtttyg

SEQ ID NO: 11085 - DNA, 1376 bp, Artificial Sequence
  Description of Artificial Sequence: Synthetic polynucleotide
tyggtatyggggttgtatttttgggtagaygttgtatgtttgtttttaggygyggttttgttgttatttttttgggggttyggagygygatagtagtttggggaygtttttygygtttagtayggtgtatttgggttttgaggttttggtygaaaygygttaagttgggggtaggtgtagygattttatatttttyggttgygygttttggyggtaggaggyggggtygggggyggggygtgagttggtyggggyggggtttatggaggggygggatygyggygttttataagtattgyggagygaggygygygttyggttagagagygagygygtaayggyggygayggyggygattttatygygtattttgttaggttttyggygtttagygttttaygygttttygygttttygygttttygygttttttttttygygttttygtttttyggttygttaggtttttttgtyggttattygttaggtttygygtyggttygttygtygtttaggatyggttygygtttygtaggtygttygtygttygygtygttatgggagtggagggttgtattaagtgtattaagtatttgtttttygtttttaatttygttttttgggtaagggttgygtygggggtyggggygggagggggtaggtatatattttaygttgggtaggtttygyggtagygtgttaggtttygygggygtagygygggtygygaagttgtggggttatttgtgggttttaggagyggggtggggggtygttyggggttatygygtttttygatattggggttgagggttgygagtygagtttyggggtttttgtgttygggggtttatttttgyggtygggtyggggtttttgggggtygtygggtagttttygttgtggtggtgatgggtgyggtggtygygggtygggattygagtattyggtygttttttagttaaggaggggtttgygygggtttttggtygyggatttyggattgttgtttygyggggaygaggggggggttygygggygggatttttggygtttygtttttatgagtttattaagagtygtygtttttggatggtggggygggggygtatattttgtyggaggttgggggygattygttttattttttttttagtttagtttattttttaatttgyggttattattygagatttttttgggggtygygtttaaaaggagygtagattttygtygggatggtttagaagttggggtgygygtattttggtygtttttgtttgggagtygatttttttttttttatttagataygttttagyggaggtttttttttagaagggttttggaggtttygtaggagtggggatttygyg

SEQ ID NO: 11086 - DNA, 3393 bp, Artificial Sequence
  Description of Artificial Sequence: Synthetic polynucleotide
gygggtgtatagggagygttaggattttagygttttgtyggattagatttataygttygaggtgatgtttattattaggtatatgaagtatttgagtatgaagayggygtagtygggtttgygtgtttggtygggttgtaggtttygtaggtaygggtagttgtgygtggttttttagygygggyggttgtgttgttygtagaagaggtaggygattattatygyggygggtayggtgtagagtayggtgaataggtttaggyggattattagtttttttagtttgtgygttttggtggggtygttttgttgtttgatgatygagyggatgyggaagagggataygaagtyggttagtaggaatatggtgtygatgaagaggtagatgattagyggygttagtaygaagtygygtaggttgtttaggttttggttgtttaygtagtagatgttygttatygggtygtygtttatygagttgagygttagtatygygatggatttgaygttgggtataagttaygyggttaggtggaagtattgygagtagtyggygatggtttygttgttttattttatatyggtygttaggaattatgtgagygataagattatttattagatggagttggttatgtygaagaagtagattagtaagaagattayggtgtatagygyggggtyggtggtttygtagygtaygtgttgttttatygygtttagtttttygtattygtygygttygttygggtygttygygttygygttygtygygttygygttygtygtygygtygttygygtttttagygtttttygygttyggygygttatygttgtaygttattttttygtggttygttattaggygtattaggtagtttatygataygaagaggtagtaggtygagaggaagataatgggtygtttygggtatttgaagygttttatgtygataaggaaggtggagayggtggygaaggtggataygaagtagagtatygattataggtygatttagaagayggtgaaggygygttygttttggttgaaaaaggggttgtggtagggtagygygtagttagygatttggtttgttttgaygyggttgtagagygggtggygttygttggataygtttattataggygygyggtattggtattygggttygtagggagtygygtygtygttagggggtygygttttttygttatygtygtygtygygagttgggggygtygtygygttttygtygttatygtttttgtygtygtygtggtgygggggtttggttttyggygggyggtygtggtygttgttygaaggyggttgttygtygggyggyggyggyggtaggyggygyggygggttgggygyggyggtggttaggtyggtgyggttgtagtttatgtatagygtgttagggttgttttgttygggtagtyggtygtagygtatgyggtygggttaggygaagtygtattggygtatgagyggygygtagtyggttttggygygttygtatatygagyggtagggyggtagyggttttttgtagttttttaggtagatgggygtgtatatgttgtataggaagaatttgagatygggygagtattggatttttattagyggttagaattggtgtatttttaggttygtttygttttgygtgtygtggttgaattgattgggtatgtaggtgtagttgtagtygatgtttttatatagyggtayggtgattttttggtatgttagttttttggtygaggyggtygtagygtygttagagygttgtagtagygttaaggyggttagtagygaggttatttttaataggtaattttattttatgttgtgygtttyggttyggtgttttygttttttaggyggygygtagaggggtgtyggggggggggtttaygagagagtygtagaygggtatagygggtgatttggggttttttttatgtttygttygggaggggggtttgtygataatttaattttttttaggggygygttygtagyggygyggttygtagtttgggtagggttttttygtattttttttygtygtttygggggtttgaaggyggttgtaggygygygttatagttygtaggttygttttgttggtttygggtygygtttagttttygyggygtagagyggtygggtttyggtttatygtttygygttygttygtttttttttygygygttygattattttttttygtygygtygggyggyggtgatttygtyggatagagagggyggaggygtygtaagttttttttggggtygyggtgygtagttaagatggttgggtygggtygtttgtygygtygggttagttttggyggttattattyggttttygggggtttatgttygtttttaaggttaagtygtygtygtygtygtyggagttggggattygtttyggtttaggtygtygtttttttttttyggygttygtttttygttygttygtygtygggatagayggattttygtygtttggaaaagttagygtygygtttyggtygtagtygggygaggtgtatatagttttttttttgttggatatttaggagtaaatttagatyggaaggyggagyggatatttgagtggygyggttygygtttagtygtygtttttttttyggygggagtagygtttttagtttaatttttyggttttagtttygttygygtygygttgtyggtttatgaatatttatatagygyggattyggttttygtttttagtttygygagttaatygtygggyggtagggyggagtttaygygtttttagggtttagttttttttaaggtagttttygagtgttygtattgttgtgygygttttttgyggatggagagttttggtaattttgggattgatygtagagatagagtgttggttatggttgtttttatggygttgagtgygtyggaggttttggtttttttatttygagtttgtttttggggatagggayggggtttggtgtagygygygttttttyggygygttttaaattagttaagtttttgttgttatttttygtaaatgtgggtgatttgtaggyggttggggtttygtgtttttyggggyggtaggaaggtttygtagtaggygagygtyggggaggtttgtyggggttyggygttgtagaagattygggaaagggtgttttttttggggtttttagaaygatggtttttgagatttggagatgtggggggtgtggagttattttaaattggggttggattygggayggttygggtgagatgtttyggagtttagttttgggygygygaggggygygggggataaatgttygttagagatttttttttygttttygttgyg

SEQ ID NO: 11087 - DNA, 1381 bp, Artificial Sequence
  Description of Artificial Sequence: Synthetic polynucleotide
tygyggtagygttagttgtatttttttttaaaaatyggaggaaggagtttgggggttaggtyggggyggtttgtaggtgtgaatatttyggaagtttttggygttttggtttttaagagtatatttgyggttgtttaygggttttaygttttgygatagttatttygtggtttygggggttttaagggyggtttttygtatyggggttttaggtagyggaatttttttttagggtttatttataaagygtggtgtygtagagttttttayggaggggttttagtttggagttygggtatygtttatttttaattygtygttagtttyggattttttygygtttgtttygtattayggagtygggtttttagagtagtaaggttattaggtggyggtgttggygtagtaggyggagygtygggtgygyggggtygygtttttggttttygaaggtgatgaagatgggtttgygggtgagttttagtagtyggtataggttttttttgyggggygggatygttaggggggtgggtgttaygttggggtttatttaatttygygygggatttatyggaagttgtggttgtattaggttyggtttaggaaggygttygaaagtattaygatgaggygtyggtagyggtttaggtttattaagaggtyggyggagggttttgygggagggygggygtyggyggygtaggggygggggygggggagggyggggtyggaggtttaggggyggtgtyggaygtagagttttaagggaggggyggggtttgyggggtgggygggtttttgaggyggggtttygggtgggyggggatgggggyggagttygatggtgggggtggggtttygggtgggayggagtatggggyggggyggggygggtttttygggtgggyggggtayggggtggggttygggatattagygygyggtaggaggtygyggtygtttaggaagagtttgtagtttygaygtygttttagttgyggttttaggatgaagtttaygaatttgyggttttyggggtagtygttgtaggagaygtaggygtygtagagtttttygtttgyggayggyggttagttatttygatggttttygaggttttatattagttttyggggtttttaatatttttaattattttttaygtgtataggggtagattygtttyggattttaattttagtygggtygtatagagtattygggggttaattttttttygtygtaygtttttaaagtygagtttagtagygtatttttagggaggtygtggygattttttttygygtttaygygggttttaygtatygtttatttttatttttttataygygttttggtattagagtagtaygttgagayg

SEQ ID NO: 11088 - DNA, 493 bp, Artificial Sequence
  Description of Artificial Sequence: Synthetic polynucleotide
tyggattygggggaaatggggtattaayggttgggttttaggagatattyggaggggttygygggttyggttyggttttttygttggggggttattagtyggtyggtagygagatatttagaggttygtttttttatygygttgttatagtaayggtttggtyggttgygtttygggtygttygttttatttygygggttygttttgagttagtgattttagggattatttatygyggtyggyggattggygggttttygataggtgygtatattyggygtaggttgtygttgagttyggaattttgtatygggagaaattttttagttygtagagtaatygtagggtagtggaygggggtygygygaggataaatagyggyggygggtgtaaagttttttttttaagtygyggggttggtygggaggtgtyggttgtataayggygtttaygtgatttaggtgtagttttaggygygtttaagggtagttyg

SEQ ID NO: 11089 - DNA, 922 bp, Artificial Sequence
  Description of Artificial Sequence: Synthetic polynucleotide
tygygggygttttgtagggatggagattgagagaggttagggattyggtttttttgggaaaaygygygggygttttagtttttygttttgyggtattttatttgttttygaggattatygttaagaagaggtttygtygtgttattgatattttatttygttttttttygygaggtgttttygagttttygaggaygyggaaygtyggggtttttygtygggtaagtattagtatttagatttygtaygtagttttgtatttttaygttttttagggaaygtyggttygttygttttygggatttttygttttttaagttaaggttttttaagtttagtgttygygygttattttttttttygattttgyggygggatttttattttygtattttttygyggggttggttaagtttttagattttttgygttgtagtyggttyggaaagttatttttaggttattttttygygygygygyggyggyggttayggtggyggyggttgygattygaaygggtttttttatgtatygygtagggtagaggagggagyggygtttygtaygtyggggttggggygttgggtagggygggygggygtggggtttygggttttttygtatttagtygygygagtygggttttygggtttaggggaggggagttgaggggyggagttatyggggygygttttygyggttgygttttttttygtyggggagygygggtaygtaattyggagggtgttgggtyggttyggagtaygygagtagygggaggagggatyggggaatgattgayggaggygggtygtagaggtygttgtgtttygtyggttygtattyggtyggagtgtgygygygtagtttgttagattagyggygggggtaygggtygtattaagtgayggaggggggtayg

SEQ ID NO: 11090 - DNA, 719 bp, Artificial Sequence
  Description of Artificial Sequence: Synthetic polynucleotide
tygtttttttggtatttayggygtttttgtttgtttttgttygggtttyggaggygygaatattattttaagtttgygatygygyggtattattttygttttttttttttttttatttygttttttttatttttttygggagtttttgggagtygggtygtygtgtgygtaagygtgtttagtttttttttygtttttaattygggttygggttttygttttttttgtaggyggattygttygtttttaggtyggattygygttygggatagggattyggtygagtygagtygtygygttagygttgygtygtyggtyggtgygtttagyggatyggagttgygygyggaatygtgttgtttygtttygttttattygtgagggtgagtaygyggyggyggtgygygggggtttgyggggyggggyggggyggggagtygyggggttttyggtygtttgattttagtyggygtygygtttttyggagggggtygggttttgtaygtgggygtagygygggtyggggtggggttgttatagttttgyggagttgtttttyggggtttttttttttggattagattttygygggaagtyggatttttttygtttttttggagtgagtaagygggatagttttgyggaaagttttygtttttaattttttagttttgygttyggattgaagyggyggtttttatttttagtattttygagyg

SEQ ID NO: 11091 - DNA, 958 bp, Artificial Sequence
  Description of Artificial Sequence: Synthetic polynucleotide
tygygttgttagtatttygtatagttygttygaaatattagggaaggggttygtaggtgtgggggtggggtggygaggttaggtagtttggygygagggagagagtygaggtttgggttaggaaggtttttgggtgtygtgtgggygtagagtttaggagagygtattgttaggttyggattttttygtttttatttygggaagaggttygttygtygtagggggaaggygggattatagtatttyggaggagyggtyggttygggtatgygggyggyggggyggggagggaggttttyggaatttygagagagtattygtgtttygygggtttygtgtttygttttygggtttttttttttttaaygtaggggatttagttyggggtagtgtygggtattggygttggygtttygtttagttttgygattttttttygtttygttttttttygtttygtttygttttttttygtttygttttygggtygtttygtttygtaggttygttattttygggtaggtttygttttttgttttygttggyggyggyggyggyggyggtgtyggagygygagtagagyggagatttttaggttttgygggygyggtgagtgyggttygggyggygggyggygaggygggtttygagagygtgyggagtygygyggttttgagtyggygtygggygggttgggtatttttaggtygagattygagaagggggagyggtygggggygtttaygggaggtagtgtgggtagggyggyggtgggaygagaggaygaggaatagagtaggygtygtgygggaagygggtygggaaggggagggtgggtgyggggttygggtatygagygaagtggggttttttaggggatggtttygaggaagatygttttagaaagggagtaattyggggtyggtaagggttttygattgtgtgatttygtgtatyg

SEQ ID NO: 11092 - DNA, 3843 bp, Artificial Sequence
  Description of Artificial Sequence: Synthetic polynucleotide
tygtaattttgaygagaagggttttttygttgaaagtttaattgtagagygttyggagygygttgtgagttygtaggaaygyggtygggtyggggaygggagaaaggygyggtygggattttgtattgtgtygygyggygtttgyggttggaatttggtttggaaygyggttttttyggttttagtttttygtttaggtttygtttattyggtygtttygttggttygtatygttgtttyggttatygaggagtttaaagttggyggygtttygyggatttyggyggagagygygagggagtygyggtygatttttgtattaygaagataattggaggtyggygggggaggygggttaygaggggttggggygagggagttgggatgygygggttyggttygtygggaaataggttgtygyggagtttygttttttttttttttgyggttttygtygygatttgattttygttttgttyggggagttaatttagtygttttyggggygttttttttttttttggatttttayggttggattagagtttttttggtagtygggttaaaggtttttttagtaaggttaaggygyggtyggttggtatttggggatttttttttagtygagtattggttttttaatygtattgttaaggattatggtagyggtaggaaattygaagggttttataggtttgygggagggaggatttattttatagtaaggaatagatttagatagatyggggattttagtgggaggggaygagaggttttaggaygttggaatgtggtaaaaataaaatattttttatttatgtatattattattttttgattgygggttggggggaagggagtttagggttaatgtgttttagattttagygttttttayggttgtgttagggttggggtggtttatttttttatagaygaaaattaagatttaaaagtatatttttattgtggtttttttattaaagtttattaaygtgatatataggttgyggygttggagggaagyggygaaayggggagaataaaygtaatagaagtaaattgttgtttgtagaggygagaggygaaggaayggaagttatattygattttagttttatttygtttttattagygtygggttagygtaggaaattaggaataggtgtaggtaagggtggtagttyggtagagttagygttttattttttttaatttttygttagygtgggtttggatggttgggttgtttgggtatttttaagggggattaggtatygygggtaggtttttaaataygtgaagggtatagggtttgaaagataaggaggggygtttaggaagggyggaaaagaggggttttggggttttttaggatattaagttagtttttgaaaayggygttttttggaaggttttttaatattttygagggaagatttggagttttgaagatttaatgaaattttagttttgattgattttttttttgygattaatttyggatgtttttatttagtttttgtttyggtaatyggttttttggggatagtagtattagtattygaygtttatygtataagtgggygtygtggtgygaggygtattttagttatttaggtyggggtgggggygtttyggtatttatattttttaagtaggtaaatttttaggtttgtttttygagaatygggagttygtattatagtttygggtaattatygaggtagtttatgtaattgttygygatgtygtttagtagatttttttttttattyggttttagagtttagtatatgggtatttttttttttttattttttatttyggygattggaatttygagtttgttttattatygttttttataaagtagyggggtgatttygtgtgttataaatattaagttagtatgtaggtttaggtaaaattttggttgtttttttgygttttttttattgygtygatggtttatagataattgtatttttataaattttttttttayggttagggggtgggagggagttagagatygggtgggggtttggygyggtattgttgagggttttgtatttaattgagtagtaatatatttatttatatggaygygggtgtataaatygttttaatattttgttttgaaagyggagttaatttttaaagttaaggattaygtagttgaatttttagtattttttaatttygtttaggygggggtaggtagagaaggggygggtagygggtagttaattygttygattttttygttaagaaggatttattaggtgaatttttygttttttatttaagtagttggttgtgtatttttyggttgygtgtgtgtgtttatatatatatatatatatatatatatatgtygttttattattttttagtttgtttttttaatgtaaygatygtatttaaaaatggtaattaaaatgattgaggagttyggtgattatattttaatttagagtatatttttygaagttgggggtgagagtagttatatagttatatttatattygggagttttttaagygtttatttggyggttgtagttttagttggtttttagaygaatattaatatygyggtygggygttyggtgaggagaggygggygtttygygggttgtagagggygaggagttggggtygtatttttaggatttgagttttaattatygttygtgyggggttgttgtagtyggtatttgtttygtagggtaggttgtagtygttgaagttyggygtygtttygygggtttttttagygttygaygggggtttggggygagttagtttgtagaggggttgtaggygatygggtyggggyggggaaygggattygggagaggtagaygaatttggggygygtygttttttttttattygttttttatttttttgtttttttttaatttttgtttttaggttttagttygyggygggtttygggggttgyggyggttttaggttttagaatagtttgttttttyggttattygygttttagtttttttttttttgggttaggggagtaagtaaatatttttyggagttttyggtagtygygtgagttattygaattttgttygggttagtagtgtagagggygatggagttggygaggygtygtygyggtttttaaggygttttttygtagagyggattaygtygttttatygtggttgtaggttgttatygtyggggaagyggygaggayggyggtagggaggtaaggygtygygtyggtggtttttttttttttyggyggygyggtttttttgtttygygagtygtagyggggygtttaggaaggagtaggttygggttttgygtttagttttagygagattaataatagttttygyggggagyggagttttagygagtttttagtygygygygtaygatyggttttygttttyggtygttttyggtyggygtttttgttagtattgttgttttatatgaaatagttgtaatttygaggtttttggggggttggggygggtgtgtgygygygygtgtgtgagtgtgtgtgtgtgtgtgtgtgtttaatagtttttttttttttttttttttttttgtttgttygtttgtttgttttygttttttattttygtttttttatatatagaaagagagggygagygagagagagatatatatatataygtataygtataygtaggttatatgaatgggaggyggtagttaattttaygaggtyggygagtygygyggygtattggygttgggagtagggtygtatttyggygygggggggygttaygtaggtgatgggygttttttygggggttaygygyg

SEQ ID NO: 11093 - DNA, 384 bp, Artificial Sequence
  Description of Artificial Sequence: Synthetic polynucleotide
tyggaagtyggggggygggtttttatagttattgttygttattagttygttattgtgtttatatagggtgatttgatttygaggyggtggaggagggaataattttagagagtatattttgtyggttygtaggaygtttgtagtyggtaaatttttggtyggaayggtatagatygtattttygtaattyggttttygggttagattygtatgyggaygggtatygtaagggataaayggygaggyggaatttaayggaagtgaagaaaagattaaygggaaagaaggaygagtaygyggtttygggatagatttttaaagtttttttttgygttttttggyggtyggagggggagtagygyggataygtttttyggttaatyg

SEQ ID NO: 11094 - DNA, 1432 bp, Artificial Sequence
  Description of Artificial Sequence: Synthetic polynucleotide
aygttttgygtttttagtyggggtttttttattyggygtyggygygtagtatgtygggagttgtagttttygygaggtaagtttygtttygtttttgtttgggggaggaggttggagagtygttttgtyggtttttgaattttgtygygaaaagygygygtggyggttttyggtttygtttttygtaggaygyggtgtygygttattttggtaatygttttttagtygtygttgattgggttgggtygyggggggygggygggggaygagaygygggggttgttgtyggygttygygtttgttagtygggttagagyggagtagygggtaggattgtttggtyggttgtttygyggagaggttgygygygtyggtygggggaggyggatagtygggttyggygtttgtggggygyggygygyggtattygggtttgagattaggygaggygtyggygygygttagayggygygaggttgyggtttygggagttttygygygtygttyggggttatgggygygtgagagtttagygygygyggtttttgttgyggtttgygagttygtatattyggtgtatagtttttygggtygttttygtgttygttttgygttattgggatyggttgttttttagygtygaggttttygaggttgtattygagtttgygtygttygttgtygtygtygtygtygttgtygtygtygttgttygtyggttttttttttttttatattyggggtttagagtaggaggaggaggggtyggtgtattttygtygttgttttttgtaatttgtaggggtyggtgtatgttyggygaggagtyggggtygttgygggtgygtgtaattttygaaggagataatttttttatttyggggygaattygggggttgtaagtygygggygggygggygagygagaggaagtaataaagataggttgtagttggggttggygaaaggggtygyggtygtygggtttttagygygggyggagagggygttttgggagyggygygggtygagttgtagttttgagyggggtttygaggggaggygtagygtygttygtyggaygtggygattaygggtttyggygaagatgygtygtttgagygttygygyggttttygttyggggygggygtgatttttgttgaayggagattttttttttttttygatttyggayggygtaggtyggygttaggatagtttttatygatagygtttttttttattyggagagaggtatygatttttaaggagggtttygttaggtagtttttgttatttttgtatggttgygattygtygagyggagygtygtggtagttgagatttggtgtttttygayggtttggttgattyggtgagttgtgyggggyggggttttgygttggagttgggggtattttttggygttyg

SEQ ID NO: 11095 - DNA, 325 bp, Artificial Sequence
  Description of Artificial Sequence: Synthetic polynucleotide
aygttagygaaggtygtttyggygtattttagataatgagygtagtgtgtaggagygaggggttggtagaggttaggaagtttttggggttaggygyggttttttatttttaygttagataaagagygyggggtttggggagttggyggttttttygttatttggggygtttggggggttttggggygggggaggygggggttttgtttaatttygttattgttattatyggttaggtygyggtttggtaattygtgaataggaggtagggttgtagggygtgagggatgatgataaggaagtyggaggagtagyggyggtagyg

SEQ ID NO: 11096 - DNA, 1242 bp, Artificial Sequence
  Description of Artificial Sequence: Synthetic polynucleotide
tyggttttggtttygtttygtaygygttggtgttatagttgtggtgtagaygttttttygttgygagggtgyggtygtttyggggygagtgtttttyggtttgtaggaggygaattygggttttttygggaggygttygtgggaaygygtatttgygagtttttgtyggttgaggagtygaggtttgygatttttgtygatttgagtttaggygtagtagygtagatttggtygtygtattttttttggttgggatgygggtttaygygggaaaggttgaaaggtggggaatatttyggyggaaaggaattttttttttttgttttgaaggaaagttttttaatatagttatgtttttggtggttttyggttttttatttttaagtttttagttagttttatatttattygttttagtagtygyggagtgggggtttttaaagaatttagttgtagagtaagttyggttgaygtagtgtgygttgggggyggggttttggaygggggyggagttayggygagagtygyggtgagggyggggttygggtgggyggtgttttgagyggggtttttagtgggyggggttttggggtggyggtygttgtygggttaygggagagygyggagttttgygttgggaggtgtayggtgtgtaygttggattggatttttatgtaatttygygttttgygttttaattaggattgtttygygygtttttgagtttygggtttyggttyggatttgtagttttttaggtggttgggaaggtaggtgygtygttgttttyggygygyggygtttygygaggtttttagttttygttttggtggattttygttgggtgggagtygggagtggaggyggtygttttagggagggaggagygtaggygggggttgtttaygggyggagtattgygyggygaagggaattttygaaggggttgatygggtttyggggtygtgataggyggygaggyggtgggaggggagygtgtgaatttaygtygggttttygygggygaygygagygaygygatttggatttttattygggatattgtaaatagatttgtttgtgaggtttaygattgggagtttgttattttgtttaagttygattyggtttyggygttygttygygttttgyggaggttttttgagttagygygyggttgtaggggtttyggggtygtatttyggattagygttagyggygggagagygttgtttgtgagyg

SEQ ID NO: 11097 - DNA, 1460 bp, Artificial Sequence
  Description of Artificial Sequence: Synthetic polynucleotide
tyggggtagtygagttatttttttaaagtygattttygggagagatttttagttggaygtttttygttttttaggagygatggttgtaattatttygttygtttttayggggygtttttttaatttttyggttggttttttttttygtagggtttttttyggtttatygttttttttttgyggttttttyggttttttaggtyggatygaggttagygtttgatttttttggtttttagtttgtttttttagtgtttaagagygagaatatygttttygtttatatgtaaaggtygggygtagtaaatgaagtgggaaaagagaaaaatagataaatygttgtggtataaaagatttttttttygttygttttgttttgtagttygggtttagtaggagagggttggggagaattggataaaygttttggaatttataaaggtyggtggtgtygggggtygtaaagggagtgaagaattgaagtagtgagttggataaattyggggtaaagtattaaataatatggatattttggtaaygygtgygygtgtgggtgggyggataaaaggatttattattygtatgattgttttaattttttattttttttgtgtaygtgtgtggaygttgttttaggttygagttygtttttygtttaggaygtatagtttygggtygtggttttygygygttyggttgtgygtttygggtttttggttygygyggtagttatagtttggyggggtttgygyggaggaggtyggttaggygtaggttgtygattttttttatttygtttagagtagtgygtagtttttgygyggaygggtagagtagtyggygygttagttygygyggtatygtygttyggtygttgaagygygyggygagtaygaaggggaaatygaagygygygyggtattgygygttgagttyggttagtygtagtygttygttygygtttaggttttttaggtttgygtygttttgttttygttgygattyggtygtgagygtgtttygttgtagttygttgttygttaggttygggtggtagygtaggatgtttttttggtttgyggagaagtatagatatyggygggagygygttaatygygttygtttygtatygygtattygagggggygygtaggtygygttyggtttttttgtttygtttygtttygttyggttttaaagaaggttgygggagggtgaagtagagtatttaggyggtgatgttttggyggaataggggygtttttggygygtttttttaataagttttggattttgygtttttyggtttttattatattyggtygggattaggatttaggggyggggygggaagtgataygtttgttttttgagattttgggttaagaagagyggaggagagagagggyggtygttgaggttyggaatttaygattaggtygggagggagtagagaygyg

SEQ ID NO: 11098 - DNA, 1064 bp, Artificial Sequence
  Description of Artificial Sequence: Synthetic polynucleotide
tygygygattgaggygttagyggyggagttggayggtttgggaaggtttyggtttttyggttgyggttttagttyggayggygtygygtaattttgttatttttttggtttagtttyggttataggaggatttygygggtaaygygyggagtttttggtatttttyggyggtgttttttgttgtttgttyggggatygatttygtatgtttttaggttgatttgtttaagttygaatatygggattatgtatttagtygggattttygggttattttygygtyggataggtaattttattagtttttaattaggatygttatygtygtttyggttgttgttgttgttgttgttttttttgttattggtaagtygygtttyggtatagttygttgttttyggtagggygttgttgttttttggtttygygggggttgtaggggtttttgttgaggaggttatagtgttggygaatygyggatttygggtgtttttyggtygtgaagtttggttggattttttgtatgatttggtgttgtaggtgtagttyggggatygttgygyggtttyggtattagataaygaygtattggtttagygatygggtygtttgagttttaagygtttttygtgygattttggttttggygaggtgygttatttttatttgggygygygtagttygtttygggatygygttyggttgtagttgygttatgaygygttyggaggggtagtagtgttattattggtattggaggtggaggtggtttttatttagttggaggttgtgattyggaatttgtttttggtygtggaagagttgttggggattagtaatgttttggaygygyggagtttggagttygttttttagttygagatagaggagtgtygygtgggtattttgttyggtttgggygygttgtttygttatggagaatttttttattattygtaggtttttggaggagttagagagggaggygtttyggagatttttttgatggattgtaaagttttttaggaattaggygtgygttatygttatatagtygttagtyg

SEQ ID NO: 11099 - DNA, 622 bp, Artificial Sequence
  Description of Artificial Sequence: Synthetic polynucleotide
tygttagttagayggtgtttttgtygtttttgtygttattygttgggtttygtttygttttaagygtattttyggttygtagggtgggaataygaggattatagtgttttaygggygggygggttaggatygtaatttyggyggagtyggygtttttgggtatttttggttttygygtttyggtygtayggtgattattygggaggggatttygggygtttygtaatttttyggttttygtgggttttygggtygtttygtttttygtygtygygtatttttygygtttttyggttttyggtgtyggttttygtttygygtagtttygagtttttagttyggtyggttttttattygtygagygtatttatggyggyggtttttagggtttttgygatttgtyggygggaygtgtttttggtaggtgttattttttygatttgaygtttaggttyggtttygttgttttaggtatagttttagttttgygaggyggggtygtyggttttattyggggggyggtgttgyggggagtagaggttygtgttttygagtygtygygygtggatattagtttyggtttaggtgygggtgggtttygaygggagygygtggtaggtyg

SEQ ID NO: 11100 - DNA, 1622 bp, Artificial Sequence
  Description of Artificial Sequence: Synthetic polynucleotide
gygtttttaaaatygagtttatygttttttttttttgygtagtttttatttttttttgtgtttygtattttaataaaygttttygttaagtgattttagtttgaaatatgyggtttttyggatttttttttgtgttatygattttttgygtttagtttttyggagttgtyggtttaatttygtaagttttttyggaattygtgttttttttttgggtagygttattattaygagygtttatttgagaggaygtttgtttttatttagtttttattttgtagtygagtaattttygtaaaaygaatatttggtttagtttttgttggaaatygttgaatagtttttattgttttttggaagggtttgggtagttyggygtggygtttayggttttattaggtttttgttttttgtaggtttygttatttygttattaaagygttygtygygttygtatttgttgtgaggttgtgttygggtygttttygtygagggaayggtttttttaaggttttgygttttaattttygttygtttgttaagaggtagtygtgtyggggagttagagtttttyggggatttttttttgtttttygtggttttttgtggaattttygttttaggatttgtaygtygtttttagtygygygygyggtayggagatygttygttgtgtttygygttgygtttttttygtttttttttygygtaggtttttttgtgttagtyggttgtygatttaggttaggaagttygaggtyggggygttattttaagggttttttygtttttttttygagggtagagaggygttygygttyggaygtattgygggaatatttggagygtyggyggagttyggttgttttygygggagggagttygaygygtatttttgggattyggattyggygttygygtttygggayggatttttgtttyggttgtaggygtagygygtagatttgagtttgtttygyggaatyggggttygagtttyggttygagygyggygtyggggttagyggagaggggyggaagtygtaagggattttyggygtttyggtttggtygygatgaagttttygtttttttttaggtgayggatygtygttgtygtttygggttgtttattatttyggygygtgttygggagtttttatttttttygggttttgtggtyggttaygygttttaggtaygygtygygtygggtygygttattaagttygttgtttttagtttttttyggtagattttttggttatttttattttgyggaggggtygtttattagatgttagaaaattagggtggggtaygtaggttaggggttttagyggttgggtatygtgtttttttygaatttggtgttggaagtgygttygttttygttttttttaggtatttatyggtattgtttagttttgtttggagggtttaggattgaaygtttgttttyggtttttattttggttgtagaggattggtygggtgatgtygygttgttttggttttgggttygtttggaagattygtttgtgtygygggttttttttttggttttggtttttaaagygttttyggtatagtttttyggtttttgtagttyggtggggtyg

SEQ ID NO: 11101 - DNA, 324 bp, Artificial Sequence
  Description of Artificial Sequence: Synthetic polynucleotide
aygtgggttyggagtagggggyggygttygygtttgattyggtttgtyggttgtttgtygttygygtaggagttggtygggygtygtttgtaggttgtttygggtygagtyggagygaygttgtygygtatttgggtagttttygggggtygygttgtgttayggtyggggtygttgygattgyggygtttgtatttgttaygtgattgagtygggtatgtttttygggtttttgtgtgagtgttatgagtgggtgtgygagatttaygaygggagtatttgtgtaggtaagagggyggygttgttttttttttygggaggtyg

SEQ ID NO: 11102 - DNA, 1881 bp, Artificial Sequence
  Description of Artificial Sequence: Synthetic polynucleotide
tyggggttttttagtttygtyggggygtttgtttttyggttgagttygttygtagygyggttttyggttattggygaggttgtgyggaattagaaggtygatygygttygggtatttttygygygtttttgattttagttyggtttttyggaagtygtttgggygatttygyggtttaatattyggttttgygaaatygttygygttttyggttyggtttggagggtttygtattattygygygygygygygttygtataggattyggttaataggygtygggatttttggagttygttttgttagaaatttgttaygygygtygtygtatatgygttttaggttttttyggaygtaggygttatygatttygttttygtttygygtttttyggttgtttygtygygatttygggtygygagygttgtygtataggygttttaggtttttyggggtataggygtygtygatttygttttygtttygygatttyggtaygttttaygtttttygtattttagattygtttttttygatttttattggatagtyggggaaaatggygttttaaagygttygtatttattttgtygaaatgygyggtttagtgtaygggygtttagttatagaaggagtttttagaggttaggtgggygtggggtgtttgttgtagtagygagtagagygtggttaggttttygtygyggtaggygyggtgtagygggaaayggagygagagtagtttttygttggagaagttygtttttaygttygygttygttttygtygtygatatggttygttatyggagagygyggggttygttggtttagaggaygygtyggggaggattygagaagtygtygtygtagtataaaggaaygagattagygtygyggtygygttttataggttgtygagyggagygygtatagagggggyggggyggggtttggagyggtygggttgggggyggggtttggtttagaggaygttttgtgtagtygggtaggggtyggggtttggagtygyggatttttggagtygtygggtagggggyggggtttgagtyggaggtygtttggagtagtygggyggagggyggggtttggagttgyggaygtttggagyggtyggtaggtggyggggtttagtttagaggatgtttggagtagtygggtagggagyggagtttggattagaggaygttagtagtagtygattaggaggyggggtatggggttgtygaygtttggagtagtygggtattgggtttgggttagaggaygtttggggyggtgggygtttggagtagttaggtagagggyggggtttggtttgggtttaygtttggggyggtygggggyggggtttggttggaattgaygygtggagtttyggtggagggggyggggtttggttgggtygttgtttatagyggttttyggggtttggaggttayggggttyggaggttayggggttyggaggttayggggttggttgtgtggggggtttaggggygtagagtggttaagtagyggtttgagygggtttyggggttttyggygyggtgggtttyggttgygtttygggtgyggattatgatgtttttagtttgggagtyggttygggyggggaatttyggttgtygggggygygggttgaggttttgygggttygygtttagagygggtgggagttaygggtttttyggaggtttagtagygygyggtgaagttgtttagtaaaaatttatggagygtttayggggagtagggattttygttaaaatttgggaattagtaagttttagttttttatagagtaggatagatttttyggttttgttygagggaygtttttttyggaatygagtgyg

SEQ ID NO: 11103 - DNA, 944 bp, Artificial Sequence
  Description of Artificial Sequence: Synthetic polynucleotide
tygygtggggtttagggaggygygggttgygggggattgygtaaggtyggggtttttggaggtygaggtygyggtgtttttygygaggttattatgagttgagtgtttttggtaggygtttagggatttttygttttttttttttygyggtttyggygggygtyggttagatygtttygttttttygttagttyggaaygttttgtattttttttttyggttgttyggygttygttagyggttagaaattttygtttygttttatgtaatyggggatttygygttttygttgtygtttygttttyggtttagaggaygggtttggggggagggggygtgtggygaygttgttatttattagggtttagtygtygttttttygagttgggtyggtgtttygygyggttttgtagttttgtagygttyggggyggtgtaggagtttyggggtgtygyggygttygttyggttgtatygttggtttttyggttygggttttaggttyggygttttttatttttaggtygygygygtttygttttttygaygatttttagtttygggttttygttatttaygagttttygttttyggtgagttgttgtttttagggtttygagtygygyggtattttttgyggttygaggyggattttttgtagttttttgattatttgttygtatttttygttttttatggagtttaggtygttgtygtggyggtygtttagtagtygttttttttttagttygtygygggggttttttatggtttatttttgggggygttyggtygtttggaatatggygyggaygagttgygggygttgttgygggtgygttgggtygygggttgygygttgttttttygttggggygttggygggygggayggyggtayggattgttgtgggttttgtagygtygtygyggygttttataaayg

SEQ ID NO: 11104 - DNA, 1514 bp, Artificial Sequence
  Description of Artificial Sequence: Synthetic polynucleotide
tyggyggygttttttttatttagygtgaaatttaygaggygyggygtttygagtggygggygggtagggggttgtaggatttaygaagttattttygtyggggatygttttttttyggagtggtttttttttyggygtttygttttagtaagaygatatttaggttaaatagtygttttyggttagttygattyggttttggagggagygtttygagggagtttagtyggaggyggagaaggttattyggttagaaggtggggagtygtyggygttttttygtattttygtttttatagtagggggaaaggttttgatygtygtggtttatattatygygtttatttgaggttygtttygttttttgggtttttagaggggtggygtatttygtttttttttgtttttaagtggtygtattttttygygggaygtttggttgggtttagggyggggygggygggygtttttygtattgtygygagtttagygygtagttttygyggttyggttgtygtygyggttagttggggygggtygggggyggggttttagggggyggggattygggggggygggtygggtygggaggygtgggtggggggyggggyggaygyggagygtttttttggttggyggggttaaggggttgagaggagtggggtaggttyggygtyggtaggaagagttagaggggtgattagagagtttaaygtttggtgtttaagatttttttygaggtatgaataagaattaggygtttgggtttttttygttygttttatygtttagtygtygygtttyggaygttygttgtgttttttgtyggyggggyggyggygggattgggtttygggagggtttttggaagtygygagttttagygaaggtagtgtatygtttttygttttttttttygtttttttttygtttttttagttttgggtgtygggtatyggtggtaaggtygttttttygtgagtyggaggtygtttattttgggaygggyggaygaggttttagggtagtygagttyggtagygggggaggygtggagttyggggyggttttagyggygggggygggaggttggttttggttgtagattgygygtttgggtttygtgygyggtttttggttttttgtatygyggaggttttyggattatagggttttttggygggtttyggtatttaggtttgtgtygttgtggttgggygtygggattagtattygagtttygygttttygggggttgygtygtgtygtttgttgtgygygygtagaggtyggatagttyggttgygggaagggattygagygtagggtttgtttygygtttyggaaagtgtttagtttgyggagtyggaggttgagttggggtagatyggygttagaygggggtttgggtgagataygagttgggggtgyggtttgtagaatttgggtttttggaggagtttayggygygttggyggagttttaggygaataggagtatyggattyggtttyg

SEQ ID NO: 11105 - DNA, 2144 bp, Artificial Sequence
  Description of Artificial Sequence: Synthetic polynucleotide
gygtygtttttttttygygtttttygaatgttaagtgtattagtttttaattttttttttgggygggttyggtttggttaattttagttgtagattttagtataaatttaggattttttttygtttagtygtttttatataaggattygtygaatatattttgaatttygygttagagygtagttyggaattgtagttygyggygygggtttaggtygggggtygygygtttttagtyggtgatttaaggtygttyggttygggggtgggtgtgggtyggtaggatygattagggtygygygggggtagttgtygggygttyggttatttagyggtgggagtygaggttggttttggttagtygttatttygtygygggygtttgtttygtygggttttygggygygggaggaaggttygygtygttttttattyggygygttttttttttagtgygtagtggtttggtgggttagtyggyggyggttggagygyggggtyggttttgygtaygaatgaatgggygttygggggaygygygygttyggggttgaagggtattaggatygtgaggatygtttygygattttgtttttttttattattttttygtttttttattttttttttttttttgttttgtaggattgagtagttaggygygagygaaaataaatagttggggttgygagygttttygtttyggtttygagagtaygtyggtttagttttttatttggggygttygtttgtttattatgaggaagattygygttaatgttatygttattttgatygtagtttggattttgggtattttttattatttatggtaggataatygagtttaygtagtatttttyggyggtyggggygygtagagggtaggtaggaggtyggagtagtttygygaggatygtattatttygtttattgtgagtaygtttygagygtyggtyggtyggttagggagtygyggygygygtttagattttgygyggyggtygagggygyggggttyggttagggttgagtgttygttgygtygggtyggttttgtatatgttggagtatttttgttygttgttatggtaatttttgtygggyggyggggttggggygtatygattaagggagggtgatagagggtgggggttgggagaaagtgttgtaagtttggtgggttyggygtgygygygyggttgggaaygtggyggttttttyggttttgygttgtyggggtygggagtttgggggttgygggagtttygtgtgtttyggaaggttgtygggtttagygygyggygagygggyggtgggaattattygtagtygagygygtaggtggtagtgygtagtttttttttagttttttgggggtagaggatatygggtgggggygtgggtaggggaaggttttttaggygttgygtttggtttygaatttttttttgagtygggttaatttgaattygttttttyggygyggatatttagttttttyggagttttttgggttgaggagaggtttygtattgtaygygttttttatttttaattttagggttygttattaygggtaggtgggtagtgttagygttygaatttggygatatttttgtatgaagttagtttygygatatttaagygggtagggaaataaaggtagtgtggtatagygggggyggyggyggggttgygggggtttttggygttttggggattygggygggggygtgyggagtygtagtygttttgtagggggygattttgtygtygttttygttygagttttaggtgatagagttgtgygtggttaggtaggggtatttgttgaggygggaggttttggtattygtygagagtgygttygagygggygtatttttttagaygggggyggttggtggaygagagtttyggaygattttygggaattattagggyggggtagtttggtyggatgaggattaggaagaggagagtygagtggggygggggtaaaggagtgaggaagygtggygatttygataaggaaagatttgggtttgggggtggaggggtgaggagattygygggggaggtgtaaggttyggagggttgaggtttgtgtggagtygaattygagaaaygtatttagaygyg

SEQ ID NO: 11106 - DNA, 379 bp, Artificial Sequence
  Description of Artificial Sequence: Synthetic polynucleotide
tygttyggyggggygtttttaygttgtgttttttgyggtgtatygaggygtattyggttgttttgttgygggttttttggttatttgtgggttatagggagagaygygtttatatattttygttygygtttaggatagttgygggagtttygggtygttttaatttaatgygtttttygtaggttgagatgyggttgtttttgttygtgtygttgttgttggttttagygttygggttttyggtgagtgyggttttgtttyggttttyggaggaatttgtaggggagtygggggyggggaygygygggttygtaggtaaygtttttaggaaaggggygatgttagggaagttgggttgggaggaggygagttygtatyg

SEQ ID NO: 11107 - DNA, 637 bp, Artificial Sequence
  Description of Artificial Sequence: Synthetic polynucleotide
tygyggtaygggagtgygtaygygygtyggaggygaaggaggaatttatygtatttatagggyggtygagtgagggagttgttggygggtgggtttggtaattttttgggaggtygaygygggyggatyggygggtgttgggaatygagtttyggtttgyggtyggtagttttygtgggtttgtgaagaggtyggyggtttttgygggygttagttaggtaagtttagttyggtgttttttaggaagttygtttgygggygygggtagggagtygtatyggttatggtggttgaggagggagaggttgttgttygtyggtygttygattttaggttttttttygaygggttygtttyggggagtaggggtgygygggggttgtttttgygygaayggttygggygggggaygtggggygygttgggygtygttygtyggtttaggygygygaatttggygtttttagtgaattattygyggttygggygttygggttygggatyggtttttttttttttygttgagtygyggtygagttggttttttgtattttatttagygtygtygggaygygattatatygagatggtatygagttttttttaaaggtttyggtttgttgaaagtggggyggyg

SEQ ID NO: 11108 - DNA, 959 bp, Artificial Sequence
  Description of Artificial Sequence: Synthetic polynucleotide
tygygggatyggggggatggtygatttttagataygggagggattgagygatgtttaaggagagtaggagaatattgygtttggagatttttgagagttaggggygggtygttttttaaagggatttyggagtttygatttttagttttagttttttttgtgatattatttttyggatagagatttaagttttaggttyggtttygtttagaggttttagggagaagattaggttatygtttattgttyggygtyggggaggaaagaggaggagtttttgtgtgtttatatttttggtygtttagggtagttyggttyggtttygtaattttagtttattggttygggagattttaaaggttttatygttagygtttttagygtttattgtgtgygttttattttagttttgtttgygygtygttttygttattttygttttagtttttgggtyggaagtttttttttttttttygtygtagtttttttttagttttttttttttygtygatgygggaaatttttttygtttygtttygttttttttttttagttgtattttygttyggttttttygtttagtttttaatttaggtttygtttttttttatttatttttygttttgggtygggttttyggttttatygtttttttttyggtttygtttyggttttyggaagttttatttygttttyggtttygttttttygaagttttttgggttttyggtagtyggygggatagaaygyggagagtygtygtttggtygggygtagaygyggtggtagagttygygyggygttggaagygagtggyggagyggygggatttyggyggattygttatggaggaggaggtgagggyggggttyggyggggygttgggttggggttttygagttttttayggggattgyggttttgggtttaggttttygtttttgttygttttattttyg

SEQ ID NO: 11109 - DNA, 826 bp, Artificial Sequence
  Description of Artificial Sequence: Synthetic polynucleotide
tyggtygttagttttgggagtttyggttgggygaygaagttgygggttggggtatyggttgtttttaygggtyggttttgatttaggggttyggttyggagttgttttttyggyggyggggttgatttaattttttttgttygaggagttgtygygygtagttagygtttygaattygygygyggttyggygttttttyggggtttatttttygggttagtygtygygtttatttgtgttygyggttyggttttttttygttygygttgttttagtyggggttgaggtatygggtygggttttyggygtttygagttttygttttttttttttygttttttaattygtttaygttttyggttttttggatggygaygyggatttgtatygtygttttgggttygggtygagttttttygtyggattgggttatggttygygggattgyggygtygtyggggtttttaygtygtaaggtttagttagtyggtyggtagygattgygaygagggggygggggyggtgygagygygtttgtygttyggtttaggggagggataggggtygyggygtttygtttygygtygtygtygtygtygtygtygtygttattatttygatygttagtggagygttygygtaggyggggtttyggaggtggagggyggtttttyggagttttttygayggaggttygtttyggaaggattttygygattttygattatttttttygttttttygtygttgtggggttttagttygagaggaggtgttagggttttttttttttgygtttttttttayggygtygtagggatgggyg

SEQ ID NO: 11110 - DNA, 2156 bp, Artificial Sequence
  Description of Artificial Sequence: Synthetic polynucleotide
tyggtygatttgatttttttttgttygygttttayggttttttggttgtygaatatttttagggagaatttgttgatttygggttggagtatggtttygaattggygttgtatgaagtyggtttggtttaggygtatttyggttttygggaggatttggtygtyggtagtygygtttttttttattttgatagyggtgtttatygagggttgttygtaggaggyggaggtyggttgyggtggttgttggggyggyggyggygaggttgygggttgygtygaggygtyggggygttygggttyggtygttaggtttgggggygttttgttttygtygggggaygygtygttttyggygatgagtygtygttttttygyggagttatgtaggtgttygtgattgttgtygtttttygtgtygtygttgtygtygtttyggttgtttagygaggttaggttttygyggaagygtttgtagtygtygttygtgttggatttgttygygtygygggtyggtttttygttgttygttgtttygagggtygagtttygggatttygtgttattygyggtygtygagggggagggygagggtagtggtygtagtyggatgtttttgyggttggggttttggyggttttyggttttttttttttyggygttttttttttygtttatgatttaygttttggtttttatttgttgygggaggttgtagagtygtttgygtatggayggyggtagtttgtttatggygttaggggtyggggtyggatygggtygggggtaggagygyggygtygyggaygggttttaggttygttygtyggttagttygttygtggggaygygttttttgtygtyggygtgggggtagttttaggygtttatgtttgggtaggttgygygtygyggggaggattttagtttygtttygagttttygggttygtygygttatattttttttygggttyggttgggygyggggatttygygttttttttttgtttttttttttttttttggygtttaggggygyggygygtygttyggttttaggygtttygttttygyggggaataatgggygtyggtyggagaggttttgyggtygyggygtttagggaatygtttyggagtgtagagygtayggttygygygggtttygggygtgygtttygygggagggttggttgttygtttgtttygtygttygggttttgtggttggttattygygagttygtttygttttttttgtttyggttygttyggttygtttyggggttttygtygtaatygagyggagtttagygattygtygggtttatattagyggtygtttttttygaagygtttttyggtagygttygggttttygygtttyggaatatttatgaagtygtygtagttygygggttgttataggagyggttttagtagtygggtttgtttatttgggttttttaaaggggtagyggygtaygggtygggggttggaaaggggyggggggygggtttggtaaggggtttaggttagattttygttagattttyggggtyggggtgagaggtatttatattgttgygtttttaaattttttttttgggttaagttgggagtgygttttaagtttgaagtttyggttttagttgygaattttttattttaagattgaagggtggggggtggttttttaatttttttattattaagttttgggttygtttttttttggtatttttgttttttagttgggttttygattttttttttgggaggygatygggttygtttggatgtagagtttyggttttttygtaatttttttggagagggggttttyggaaatgygtygygtyggggaggtttttayggtttttttgtgatatgggtagggtgygaatttygygttagttttttttttgtaaagtttygtagtagttaggtaaggagggygtggggaaatagggagataygtatagggygygygggtgggatttagtttttygaggtaagatttygaggaaatgygtyggtaatagtgayggatgygagattygaaygtygattttygtaygygtttttttttyggtagtttygagaaagggataagtyggttgtagyggggagyggttgggtyggtttttyggayg

SEQ ID NO: 11111 - DNA, 1441 bp, Artificial Sequence
  Description of Artificial Sequence: Synthetic polynucleotide
tyggagggaggaattatygtaagyggagatttygggyggyggtyggyggaagggttgggygggaggygtygggatgtyggtaggattttgygttygagggggtagggggttygtgtyggggttttaggygtagattgatggggtttaagtagggaatgtgagggyggggagggygtataayggaagggattaatttygyggtttygagttgggagtaaatttygttttttattttttttattygttttttttttttagtgaagayggtttgggggygggtggggaggygygttttyggagygttttygygtttttttttygtttttygygygygatttatygttttttttttttygaggttagygatggttygggtgygggygaggagttgggagggyggttttygaygtaggtgttagattygttyggtagtgttyggygygttggttyggtttttagttttttyggtygtygtttttygttygtygygtygyggygttaggagggyggggtyggggygygygtygttttttagtaagygggygggyggygttyggtttgagggagyggggyggttttygtyggygtygygygygttgtgtgtgagyggggtygygygygygygyggtaggygagtgagggaaygaggagyggtygggtgtgagtgtgtgggagtgagagtgtgtgggagtggggtgagggagaagttgaygggaygygaggttgtgagaaattgggygagtgtgygaggaygttyggttagtttgygggagtygtagtyggyggaggagaaaggaggyggttttyggtatttygattttttttttttttttttttttttttatttttagtygttyggyggttygygttttttygaaggttttagttyggtttagtyggtygagagygagggaggagtttttygatttaggtgagyggtaygatygttgttgttttygggtgtagagtagtgaggygaaggygygttttttygagtgggygagtttagyggaatggatttttygattagygggggttgggtyggggaggggatyggttygagygygttyggggttyggggttagttgaggtyggtggtygtygtttygyggagtyggtggggagygaggyggggttyggttttygygygtgtgtygggaggygtyggttygtggygtgtgygtgygatygggygagtygtgtygagggggyggygatttygggygtgtaaggagtatggttttttygtyggygagggggtgtggtaatttygggaaygtyggttggagtyggattygygggttgttgatttgttttygggattgyggygatatttttttttttttttttttttataaattttatggagygatygygggaggaggattaygtggtgyggtttygtagttattgtattygattttaygtttttttttttayg

SEQ ID NO: 11112 - DNA, 734 bp, Artificial Sequence
  Description of Artificial Sequence: Synthetic polynucleotide
tygattttgggtatatagyggtaaattttgtttygtaatatygtgtgggttttygygtattttttygygtgagygtttygagttyggtgtagtttyggttttygygygtttttgtttttygtatagygttttygtttygaaggtgttttgataatttygtaggygttattyggagtyggggtagggtagttggggttggaggyggygggygygggayggagttttatgaaagttggaagaagtgattataaatygggattygattttygtagttttggygttygtttttttaygtaggttygggatgtyggttttagtttttagatgtygggaagayggygtyggttagtttaaggaagagtttttaggaggttggggagtaagggtgtygggttttttatgtygggttaggttttttaggagtgtyggtttttagggttattaggtttaggtttgygygaggagggagygygygtttttttttatttattyggttttygtttttaattygtttttyggtttatatttatttgtttggttgtaagygtygtttygggttaggtagttaggtttttatttttagtgyggygygtttygatgtygttatygggattttygttttttaaattagttttttttttattygtaatttygttygtyggggygttygggggyggaggygygagtyggtyggygtygyggagtyggttygtagatagggygggyggggttyg

SEQ ID NO: 11113 - DNA, 935 bp, Artificial Sequence
  Description of Artificial Sequence: Synthetic polynucleotide
gygtgygattygygtttattgtggtttygttttattgatgatygtgaatttgtagggtgttgggttagttttttattttaaggttgggtaggttttyggagtttttttyggtttagatagaagtttttttaggagygggggaggggaagggggygygyggttyggttttaggtgtggtygyggataatgagattttggggatgggggygtatttgygttayggygtttygtagagggttttttaggagattttttygggttttygtygygtygtgggggtggggtagttttgttggttagagtygggtaygggtygggygggyggyggggatygtgatygyggttgygtgygttygygttygggygtttttgtgyggggttttggtaygtyggygggggygattygggtgtyggttygtgygggygataygygygtttttgyggggttgygyggggttyggagyggttgggggttttttgtygggygyggttgggygyggggggygttttyggtygggatgagtttatygtagtygygtyggggttgagygtygagyggggyggyggyggggygggyggyggtttttyggyggtttygyggygttygggtygygygtygttatgttgggtttggaygygtgygagttgggggygtagttgttggagttgtttyggttggygttgtgygttygaggtgagygggtygggtaggggyggggggttyggttggttttagtttygggyggggagtagtttttttttygyggtaattttgggggygygtatggggatttygyggygtygatttttyggttggggtttggtaggggtgggggattttatttaggttttagttttgtggggaagggattaggtgyggaygggtyggtttgggaagyggyggygttgggattttttttttttggatatygtyg

SEQ ID NO: 11114 - DNA, 1054 bp, Artificial Sequence
  Description of Artificial Sequence: Synthetic polynucleotide
gygyggttttyggaggtygatattataaygtttgtaagggtyggttggggtyggtatatgattygattttayggtygtttttaggggtggaggggtygttattttaggtttggggaaggaataygaggttttgaggagygaatttgttttaggtgttyggggaggtttggygyggggttgtttyggtttttttttagagtyggggagaggggatatygtaggatgtyggygttygaggyggtagtattaggtttaygggygttttagtttaaatatttttygtgtttttagagyggggattttygttttttagattyggaagygtygtttttttygttagggaygtttgggttttygtagatttygtyggtyggygygttattygygttagtattatggatagyggtygttttagtygygygtttagggttaggttygggttggtttttatygyggayggttgyggggtyggggtagtttygtaattttaaatttyggtagttttygtttagtagggaggggtttygggggygaagagtgggggagaagtygggaaggattyggaggaggyggygggggyggygttaggggaggaataatttyggygtagtgtygatttaggttgaaaaygtttttagttatgggtttgtaygtggagygtyggggttgggggaggtattygyggggtttttttttygtttygttygggagtttaygtttgtyggygtttatagtttygtttttatttttaggttttagggtygagatggagaaattaagtygtattttgagagtttataggagggaggggataggttgaggagyggtygtttgggtatgggttyggggtttggttttttttatttatattygtagygttgttagaaggygttgttttgtttgtggttagttttygattygtgtgtttggtgggagttgtattttygtataggtagttttattgttttttaatttygygtttaygtttttgtyggttttygttgttttttatattttyggtttgattgatttagttygaatattttttatttyg

SEQ ID NO: 11115 - DNA, 1474 bp, Artificial Sequence
  Description of Artificial Sequence: Synthetic polynucleotide
tyggaygttgtggtagaggaggttygygygtygtatatttgttgggatttttagttygtttaggattggtagggagattttggaagattagygttyggaggggtgaggtttygttttgggggtaaggtygygaaattayggtttgtagttttaygttaggggtataaagaaaagygtygtygggaatttaatatttgtagaygaygygtagtygtagaggaggyggggygttygaggtttygtttygtatgttaatgaagtatatattatatygtttygtttyggygygagatyggtttaaygttgyggagatttagaggtyggyggygttyggaaatattygyggaggtygaggtagggyggggtygggygtyggggtygggtygttgggygggyggtatagttygggggaggttaaygggtyggtygggygtttyggggaygygttttttttayggtgygaagtggtayggttygtaggggyggggtttaggttatgtgaygyggtygyggtygttattttgttttgyggtgttggtatttagagygtagyggttgaygggtyggatygttttygtygtygttygttygtaaattttygtgttyggttygttttygttttygttttygttatygtttyggtttgtagagtttgttttttttttattygtagatatgttygagtttaagagyggtttygagtatgtttygtttttygtygttatgggygtttyggtygttatggtttttagyggtgagygyggyggygggagggattygggggygggggygygygygttgtttatgttygtagttygtyggggttyggtgtgtgaygttattttgaygtaatttygagttgtygggggygttygggtttygtgtgatagygggygggggtyggygtttygagggttgyggggagtygtygggggttyggggygtagggygtgygggtttggtyggggtgtgagtttygggggttygggtyggyggttttgttagtygggtygtgyggttgygggggtggggyggyggygtygttgttatattagtttygggagyggygagagggaggttggggtgggggygygaggggggyggygygaggggggtygattttgygggtaggtgatattatatttygaaggttttagtgygygggyggyggygygggttyggtttaggaaygtttagtyggtygttggagtttttyggttggtggggagtttatgttttttaygggaggtttttagttttygtttttatggyggtyggtttygagggttaggtgggttttatttataggtaggtattttyggttggagttggttatagttgtttaatattygtgtygttgtgtgggttgtttgggaaagttgggttgagggtttggttyggagagttygyggagattygggtgggagtgtgtggaagtggagggagyggggagatagtagtatyggygttggyg

SEQ ID NO: 11116 - DNA, 357 bp, Artificial Sequence
  Description of Artificial Sequence: Synthetic polynucleotide
tyggagaatttygtatatataygtattygtaaataygygggttttttgygttattaggaagtagtygttagaatygtygggtgttttttaattatttttgggagatttggtttttygttttygttygygygygyggttayggygtttttttttttttygggtttttaaggtyggattatyggtttygttgttatggygaygtyggtttatttttttttattttygygygtttttaygtttttttttygtagggagttggggtttttttttttttttttttaygttygtagggatttataggttgataggagtagggggtygtttgttgttatyggtyggggatttyggggtttttyg

SEQ ID NO: 11117 - DNA, 814 bp, Artificial Sequence
  Description of Artificial Sequence: Synthetic polynucleotide
tygtygggagtttyggggttyggttttagtttygggttgaataagtagggaggggagaggtatttaggtttygttttttygyggttttttttttttagtyggggaggaggagatttaggaagtygygttyggtttyggtgggtggagggtttaggtygygttttttagtttygyggttttaggtttyggttygttygaggyggagttygggaggtyggggyggggtttygggtyggttatttatttgggttgttagttattttagtttygygaatagttggtgtygtygttgtttagtygagatttyggggttttgyggtttattatttttttygataygatatggttaagygtygtygttygaatyggtygtygtygatatttygtttyggttyggggttgaggaggaagtygagaaggaggaggaggaggyggyggyggagggygggggaagaggayggtygtttygggtttygtttgagttygtagggtaggaygagggagyggygyggtgagagaggyggatgaaggygaggygaygttttttttagggtygtgygyggtttaygaygttggggtttyggaggaygaggaggaygaggagtaggyggtggyggtagttttttaygtttatayggttattgttttttygtttttyggtttygttygtygygtygtygttgtygtayggtaagttgggagygagaggyggggtyggtttygtygggtttggggagagaggygggttttgtyggyggggyggggtygatagtaggtagtttygttttttayggttttaggtttttggayggyg

SEQ ID NO: 11118 - DNA, 847 bp, Artificial Sequence
  Description of Artificial Sequence: Synthetic polynucleotide
aygtaaagygtttttttttttattttyggagatggtaygtgygygtttttaygtagtggyggttgttgyggygagtaygttttttgygggatttaygyggggagtgggttggtagtgygygtatagyggyggygagtgggtygtgtaygyggatgyggggtgggagtgggggygtaygygygggygtgggygagygggtttyggtagtgtatatatayggtaggggygggygatagatgtagtgygtgygtyggagtttaagygtataaayggaaagagygggygyggtgygtaggggygggygtttagygggtttggtatgygygttttygttygaggttataaaagtatygttatttgttgttattagttaagtygygygtttagttgtttggagaagttygtttatygtttttagttgttgtttttttygatatggattttgagatttgtttttgtttttttggtgagttttygttttygttygtattttgygtattgygygtttttgtatttgtaaagaaatttaygttttgygttttygtttaaggatatttgggggaagggtttttgattttttattttttatttygtgaagggygggtatgtttgtgtygyggagaatagggagatttggtattttattttttygtgataggygtggggattygagttygtttatattaattttttttgtggygtygttttttttaggtggtttttgtatttgygyggatttttgtaagtgygagggatgtaaatgtattttttgtaagaagagtgagtgyggggattttttttttttgtygtygttttttttgttttgyggagtyggtgttttattayg

SEQ ID NO: 11119 - DNA, 589 bp, Artificial Sequence
  Description of Artificial Sequence: Synthetic polynucleotide
aygggggtaggygtggygtttttgggattgtyggaaaaygaygtgagggaaaaatttagaggttaygaaaaggygaatagayggagggtttgttttaggggagttaagtagttygtttgaagttttttatttggaaatgaygtgtttaattyggygtttttgtagtttyggtygtttttttttgtttaatttygygtttttttagtttyggtygtttttttygtygtttttttttygyggtygtttatttttgagatttttggttttattgagaygtttagttttattyggtaattygyggatattaagygttataaatttaaataygagatttagagaygttgggttttaaaygttttttagagtgaaagatagaggaattaatygaggttyggttgattttagaygtttaaggygataggygttgttaagaaaagggggtgggaygatatttagttgttaagaygayggttttygggtgggyggtttgaggtggttttyggtygttaggygagatttygygggaaaattttttgttagagagattaggagatttggggttgyggtygtttttttyggagtatttayg

SEQ ID NO: 11120 - DNA, 848 bp, Artificial Sequence
  Description of Artificial Sequence: Synthetic polynucleotide
acggggtcgtattcgagtcggcggagtatttttagggagggggcgggaggttttttttgtttagtttcgagtcggtggtgtagcgttcgttttcggtcgcgggcgtagattggcggtcgttttcgggttacgtggtgcgcgcggcgggcgcgttcgaggagtttgcggttgtttttggtttatagcgtttcgggcgaggagagcgggcggacgtcgggggttgggtcggtgcgggcggcgaggtaggcggacgaggcgtagagatagcggggcggtcggggcgcggtagtcggcggcgtcggggtcgcggtttttgttttgtcgtttttttcgcgtcggattttcgcgtttagggcgtacggtggagagggacgcggcggagtcggtcggtagttatggaatcggtttttttcgtcggcgtcgagttgtagttttcgtttttcgttaacgtttcggacgtttattttagcgtttgttttagcgttggcgttaatgcgtcggggtcgttaggcgcgcggagcgtttcgtttttcgttttggtaatcgttattatcgcgttttattcggtcgtgtgcgtcgtggggttgttgggtaacgtgtttgttatgttcggtatcgttcggtgagttcgttgcgggtcggcgtcgtagggttggagttcggggtgagggtggggattacgaatttgagattttaagttcgttttttggatttttcgcgttttcgtattttttgtaggggtatttggggtttagcgagaggcgaggttatttatatcgaggggaatataggaatgtgtgttatcgtgtgtatgtgtgtgtgtggtgcgggggggggagtgcgtcgcg

SEQ ID NO: 11121 - DNA, 1230 bp, Artificial Sequence
  Description of Artificial Sequence: Synthetic polynucleotide
acgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgttcggcgtcggagttatgatttttcgtcgatttaggaagttgtagtagaaggaggaggcggcggttatttcggatttcgtcgttcggattttcgattcggaagtcgcgttcgtcgtttcggtttcgatttcgggattttttgtcgtagtcgttatttttgggtttttagcggacgagttgtacgcggcgttggaggattattattttgtcgagttgtatcgcgcgttcgtcgtgttcgggggtattttgtttcgtcgaaaggtgcgtttttcgttcgtttttaggatttgtttagttttttttcgattttttatagggtttgttgatttcgtagtgtttttttttcggcgttcgcggagttttttattttttttttcggttcgttgggtgtttcgatttttcgcgtttttcgttgttgcgaaggtcgtggttttcgtttgtatatcgcgtttaggttcggtggtttttaatttcgcgttttatgtacgttttttttttttttttttgattttttttagtatttttttttttttattcgttttatttggttttttgttttttatgtttcgttttttcgtggttaggtgttttgggtttttaggagtttttcgttcgagggatagagatagttttaggtaagttgaaggttcgagagttttcggtgggagaagcgggtcggtggttgcgtcgcgtgcgtttttattttgaggaagtgcgtggggagtcgttgatttcggatagtatattttttcgaggggatttttcgatttttgggttgggggtttgtcgtttggttttacgtttgacgtacggggcgcgagggttattgttttttggatttttgtcggaatcggacgtagtgggaggggtcgtagggcgttcgcggggtaggaaggatgcgggtcgcg

SEQ ID NO: 11122 - DNA, 1094 bp, Artificial Sequence
  Description of Artificial Sequence: Synthetic polynucleotide
gcggcgttaaaaatagttggggggagggtgcgggggcggcggagtttgtaatttaagtcgttttagttttcggggggtagatttcgcggtcgtcggtcggcgttcggtttttttagtattcggtttagggttggagttggttgtagggttggttcgcggcgatttgggtagggtggcggttgttttttttttttttatttcgtttcgaggcgtagcgcgcggtagagcggttcggtgttcggcgggcgggcggttcgggcgggtttgcggtcgggatgaggacggcgttttcgttgtagagcgttggggcggcgcgggtcgggagttcgttggcggcggtcggcgtggcgggcggagcgggtttcggagcggaggtgagtgcggatgcgtcgtttgggcgcgcgcggtgtttggggatttcgggttggaacgcggggcgggggtgttatcgggttgcgcgggggttttcggttcggttttcgtttttgcgttttcgggggtcgtttttcggcggggtcggatttttttagcgttcgcggcgttcggttcggttttttcgatttttttttttcgggttcggacgtgcggggtagcgagcgtcggggttcggcgggggtcgtagttttgttcggagcggagcgttggtagcgcggggttcggtttcgtgggtagtttgggaagcgttcgggtaacgtattggcgagggtcgcggagcgaggggttcggggagcgggattttcgggcggggttgcggggagcggggttcgggtcgttttatttatcgcggatcggagtcgggggtgttttagtcgtgtcgtcgtttttttcgggtcgttcgttcgggcgtgttggtttcgcggcgtttcgagcgcggtataggtttgcgagtcggcggtgttagcgtttcggacgggggtgggagttttggagtttattttgggggagattacgtcgtattttcgtttagtttcgcgtatttttagaggtttttgtagagtcgggaagttggttggacgtttagattcgtggggacgcggcgtttcgcgtggcggcggtcggaagggaaggttaatggggttcgggggattttcgcg

SEQ ID NO: 11123 - DNA, 1979 bp, Artificial Sequence
  Description of Artificial Sequence: Synthetic polynucleotide
tcgttatcgttatcgttttttttttagttattttttatattcgttcgtttattttttttttaatattttttatacggttgttcgtatttttgttttttttcggtttacgcgcgttttttgtaatttcgacgtttttaggtttttagttcgtttttttttttcggttcggagttcgagagtcgtttgtttttattttaaaatagcgataataatagggacgttgagaataataattacgattagtacggcgaaggcgtttttttcgcgggttagaggtcggcgttttagtttcgtagaattcggcgttcggttagcgttttttggtagtttttttcggtagttttaggtttttaagatttgtaggttcgtttcgaagtttttcgttcgttttttacggtcgtttcgagttttcgaggttcgtttcggagttttttgttcgttttttacggtcgtttcgggtttttacggtttttaggttcgtttcggagtttttaatcggttttttagagtcgtcgcgggttttcggttatttaggttcgttcggagttttcgttcgttttttacggtcgatttaagtttcgtcgattttttaggtttttttcggagttttttatgggttttttacggttatttcgggtttttaaagattttcggttgtttcgaattcggattcgtaggttcgtttcgggatttattattggttttttacgatcgtttcgggtttttaaagattttcgtttattcggtttcgattttttaggttcgttcggaggttcgcggcgtagtttcgtcgtcggggaaggtttgtaggtcgtaaggtcgcgcgaatgtttcgtgttcgtttcgattatcgtttttagattagcggcgttttttatcgtgtttcgagggttgcgcggtttcgcgacggtttagcggcggggcgcgggcgttgtttatgtagttcgcggtcgcgtttttcgggtcgcgcggttcgagcggtaaggcggcggcggcggcggcgcgggttcgggttcggtagagttgcgagggacggcgggaggcgagttcgtttttcgggcgcgtttacggttcgggcgagagtcgcggttttcggtgcggacgttattgatggggcgtttggtcgcgggttcggcggcggcgttttttcggttggggttttcggtttatcgcgtatcgttttagggcggtttttggttttaggatttagcggcggttgcggcgggagtcggtcgtatgagacgttttcgtttattggttcgtcgtattcgttatcgttattggttcgtttcggtcggtcgtaggggttgtgtacgttatagcgtcgtgagttagtgcgttaatggagtgaaggagagaggcgggattgatagtttttttggcggttcggaggcgggattaggaggacgtttcggtaacgattgggtagggttttgcgtaagggcgtatgcgatattggaagtagcgagtaattggattggttgttttcgtcgtaaaggagggtgggttttgtattttcgggtttgacgattggtttttttaagtgtcggaagtaatagggatgtcgtttggaaataaaatttggtattgaagcgtagggagataaaacgtttatttttagagtcgaggcggcggttgtttgtcgcgtgttcgtggttttttgtttgttttcggatatttcgggttacgttcggttcggttttcggtcgcgttgttttaacgggcgttacggggtatgaagagttttgggcggttgcgaggggagggtatcggggtagcggggcggtcgttcggggttttcgcgcggtgatttttgttttgtcgtcgaagagaacggttttcgggcgcgtcgcggtcgcggttttagagtttttgggtttcgcgttttgagagtttgagtcgtttgaggaggttaagcgtttacgaatcgtattttttgttttgttagttagttttttaatacgcgaaaaaggtagacg

SEQ ID NO: 11124 - DNA, 1930 bp, Artificial Sequence
  Description of Artificial Sequence: Synthetic polynucleotide
tcgtttaggtagcgcgttgtttcgggtttcggtagggtggggattggtcgcgaaggttagagaaggtaatggtaggggaggttagtttttgtcgcgggtcggttgtagagcggacgtttcgttttgttttcggtttttttttcgttcgtcgggttcgtcgtgtcgaataattgttgttcggagttttcgtgacgcggagttttaattgttgcgattcggaagaagcgaaaaggagtttttttcgtttcgtattttgagcgttcgggcgtgtaaacgtgggtggcggagagcggttgttttttttttttttgtttttttttttttcgcggcgttttcgtgtgtgcgggtgtgtgagtgcgtgtgtttttttcgtttattttcgtatacgtttcggtattagtgtaggcggcgagtcggcggtttttcgttcgttcgtttcggtagttgcgttttcgtttcgtttcgtcgtcgtcgtcgtcgtcgtcgtcgtcgtttttgtagtcgtagtcgggtatggtgagtgagtgaggtttagtcgtcgcgcgttttttcggttcgtcgtcggattttagttttaatcggtttcgttttagggagttagtttgcggcgggagcgcgttgcggggtcgggcggttgggggattcgggcggtcgagttgcgtttggaggggcggttcgtgcgttttcggttttaggcgcgtagggtcgcgggatttcgttttgggagcgggttttacgtttttttcggtttcgagttttttttttcgagggttgcgcgtatttttttcgttcgtttgttcgcggttttttttttgttttcggagcgttagtcgttttatttcgtgatcggtttttcgttttgtttcgtaggattcgttcggacgggattacgtcgtcgtcgtcgtcgtcgtcgttcggagtcgcgtttcgggttttgtttgagtcgagtcgcgcgcggggtcgtagttatcgtcggcgggggatggggttgtttaggaggcgcgtcgagttcgtagggggagcgcggagtcggcgcgtagtttgagagttcgagtagttcgcgtcgggtcggttcgtgcgtatcgcgcgtcgtcgtcgttattgtcgttcgcgtttcgatggcgttatcgtttcggagtcgttgatcgtttagcgtttttagttcggttcgcgcggcgggtttttcgagttcggttcgtcgggggagcggtttgtcgcggaagttttttcgcgttttttcgttcggtttcgttatggcgttgcggcgttttttgttgttgttgttgttttcgttggagtttttggatttgttgtttagcgtttacggagttcgcggtcgcgtcgttaatcggattttgagtgtaggcggcgttgtcgtcgggggtcggagggtcgggggcgttttggtacggggcggtcgcgagttgaacggtatcgttcgggcgttcggaatttcggaggcgggaagtcggcgggggtagttcgcggcggttgtggcggcggcggttagcgcggtcgttatttacgagacgtgttggggttattacgacgtgagcggttagtacgataaggagttcgagtgtaataatagcgagagcggttatttgtattgttgcggtatttgttattatcgtttttgttgtaagaagcgttacgagaagttggattagcgttagtgtattaattattagagttcggtgtgggtatagacgtttagtattaaggtggtgtcgtcggggttcgagaataagtacgattcggagaaggataagattaattttatcgtttatattatttgcggggtgatcgttttcgttatcgtggtcggcgttttcgttaaggttttttacgataaggtttatcgttttttacgggagatgaatatttataggtgagagcgtcgcgtgtcgcgcgtttcggttttttcgcg

SEQ ID NO: 11125 - DNA, 3177 bp, Artificial Sequence
  Description of Artificial Sequence: Synthetic polynucleotide
tcgcgttagtttcggggtttttattttggcgggaagggtaggtcgattcggtagattgcggtttttcgggagggaagaaggtgttagacgcgcggagtaattataaatagttttttttttttagaagacggtacggggtttaagatttaggcgtcgtatatttagaatgagagtagagattttcgttaggaaaaaaaggtatttaggggatttgtttattagtatgaaatgtaaatgagttcgttcggttttatttatataattttgtgtatggattcggcgaaagggtaattagggagacgacggcgtagtagttattttgttattttttttattttttttttttatcggtcggggcgggaattgagacgattttaattttttgcggtggcgggaggtgcgcgggggttgcgtgggtggtgtagttttaggagagtgaataacgtttaggggtgatggttttagtaaagtgaggggtggtgatggaggttattcgatttatttcgtcgttttttcgtagtggcgtaagcgttttaaaattttcggagagggaattgattgatttattaggtttcgtcgtgtttatttttcgtagatgttggggaagtgtttttcggcgtttaattttcgttgtttttttttttatcggcgtttagtatattcgcggcgtttcgttttcgggtatttatagttttttggagtggcgtcggcggtaggagagagttagagtcgattgagttttagaattcggggaggtaggcggggtaagggtcggggtttgcgcgtgcgtgtgtacgcgtggaaagtataaatttacgagggttcgttgtcggtagggttaaggtgagtgagtgaaggcggtagattcgcgaagttttagtttcgcggatattttttttttaagttatatagggatttaagagaaattgaggtacgaagttggggggtggcggtggtggggattttgaaggtcgagtcgataaagtttagttttgtgttttcgtttttttttatatattcgagatttttataggtttttttttaggggttttcgttttgtttcgtagttttttttggggattcgggttttgcggtttagcgcgatttgtttggggttacgtgtttaagtacgaagtttttgcgtggagtttacgttttttaaaaggtttttaggggtaaagggatgaagtttaggagcgttaatgtgaggttaggtttagcgggttagggttacgaggttagggtcgaagttttagaattgattcgggagtatgattaataagtttaagagatttgtggaggttacgtttagattatgtttattttagtttttttcgagtttcgttcgtttttttaagattgggtttttttagtttgaagttttatttttaggatatttagtttcgtttttttttttttttagtttcgtagttaagtttaattttagggtgggagattaattaggtggagatttgggatttcgttttgggattttttggtgataatttttattttcgtgtcgtttgtttttttttttttttaggttcgtttagagttgagtttcgtttttcggttgttgtttaaattaggggtcgtggataaaggatgtttggggtttgcggttttacgttaggatttcgcgtcgaatattttgatttttcgggttttttttaagggagttttaaagattttaatggttaataggaaagtgggttcggtttgggtagtagtttgattggttttagttttcgggagcggatttaggggtaaggggaggggagaggggcggttttgggttttggggtgggaatcggattttagttgtggttttttttttgcgttttcgttcgtattgttacggcggacggttaatgggcgcgcggttcggggtcggcggcgttcggcgattggttgcggggttgtttgggggcggggtcgaggtttgaagttgaagtgagggatttagttgtggtgtgcgcggggtttttcgtcgtcgttttcgttcgttcgtttcgcgtttcggtcggaggaggaggttgtggcgtcggcgatagttacggtagcggtagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttgattttttagattcggttttagttgcgtcgcgggaagagggggcgttttttttcggattttcgtttttcgtcgttgttttttttttcgttcgttttttcggggcggtttcgtcgaaggtagcgtcgaattcggtaatcggagtttgggcgcgaagcgaagaagtcggaataaagtgagggggagtcggtcggttggttcgggaagttttaggggcgtaggggaagcgggattcgcgtcgggcggggtttttttgcgtttcggcgtttcgcgggtagtatgtttttgcgggtagggggagttgggttgaattggttttttcgggggtttagtttgcgttttagagtttattagatgtgttttcgtcggggttttcgggttgcgtgaggatattttttttgaggggcgtcgtttgttttttttcggatcgttcggggtttcggttggttagaggatggacgaggaggaggatggagcgggcgtcgaggagtcgggatagtttcggagttttatgcggtttaacgatttgtcgggggtcgggggtcggtcggggtcggggttagtagaaaaggattcgggtagcgcggatttcgaggcggaggggttgtcgtattcggcgttggtttcggtggtttttttttatttgagttaggatagtcgttcgcggagttggtgttttcgtacggtttgtaatttatatttttcggggtacgacggttaggcgcggggttagaagggggacgggtcgtatcgtcgggggtcgggggggaagaagatttatcgttaggtgagtcgaagtgagttcggagggtaggcggatggggggggggttgttagggaggggagggggtattagagtgggagcggagacgcgagtaggtttcgtcggtaattcgggtttattttatttgcg

SEQ ID NO: 11126 - DNA, 2195 bp, Artificial Sequence
  Description of Artificial Sequence: Synthetic polynucleotide
tcgttagtttcggtcgttaagtaaatattttttttaggagttcgagaagtcggtgtgcgaggggaggaattagtttgaggtttatcgttttagtaatttcgggtgatttatagagtttagattttcggttgtcgtagatcgcggtaggtacgtaaataagtagttcgggagatattttttttttttttagttttcgtttttttattttgttattttttagttcgtgattagttgttttttttttttttcgcgggcgtttagggttgagtaaatatttcgggtcgttcgtttcgttattagttggtttcgatcggcgtatcgttggcgattttttaggtaattcggcgttatgagaatcggtatttcgagattcggcgttttgtttttttttcgcgtttttagggttttggttaggtttaataattttttttttttttgtgcgttttagtttttacgggtttttggcgcgggttaattaggtttcgttgcgggtttttaggattgcgtattttatttttcgcgaggttagtagtttcgggggaaggcggtcggaaaattttttgtttatcgggttggataagtattagtttggattcgttttttaatttttgcggtttagttttagtagatttttggggtcggaggggaaagggtggtaatttatagatttatttcggaatagggagtggggggtggggttggtgggaatttgattttttggaaaggacggattcggagttagagttaacgtgtttcggagcgtagaggtttagggggtcgcgttaaatattgtatttcggggaataaaatcgtgaaggttaattaggataagtcggagtagggaacggggacgtcgggaggggagagcgcgtttcgagttgggtagaatttggaacggttataggaaattcgggcgcggggtagtcgggtcgagggggatttttgtttacggtttagagtggtttggattcggtttacgcgtgagaggagcgtttggtgacgattttacgtacgtttggtgattggtggaggttttagagaaggatcgtgcgtgtaaaaggcgaatttcggtgtgcggtgtgtttacgtgtgtaagttggggaggggagggggcgtagaaggcgtgataaagacggattttgttttgagtgtgcgtttcgtttcggttcgtttttagcgaattgtgtttgaagtgtgttttacgggagggttaggacgaaggtgataaaggttaggtgttttttacggagacgcgttaaggtagtttcgcgcgtgttcgtaggcgcgttttttggaagacgcggtggggggtgcgtagggttgtatttttatattaattgtttcggcgaaggtcgagtttagaaagtgagtgcgcgtgagtgtgcgcgcgttcgtatgcgggggcgtggtagttaatagtaataatttatacgtcggtagggttagaaatttttattttttttattagtcggaaagtacgagtcggtttagtttggaggtgagtcggggcggggagggtcgggtaggttttgtttttgtgtaaacggagcgtacgtatttggagcgcggcgggcgttcgattagcgttttgaatggaggtgatgtaacggtgatgtaggttttagtttattttcgtcgaaagtaaggagttttgtttggggataggttcgcgcgagagcgagtaatttagcgcgtttggtttagtttcggttttagggagaggtaggttttgcgtttcggttcgggtttcgttattttagttaggatcgggtttggtttagcgtttcgcgtcgcgttttttttattttcgttcgtttttcgtttggggttggagttggttttaaacgttgcgttggagcggggtcggcggcgagttttaggtaagggttgttgttttttcgtttcgtcgttcggaagagtcgggtcgggacggcggggagtgggcgagggtagaggcggggggattggatattttgcgggttggggacgtcgcgttaatttcgttcggtcgttgaaagtttttaaattcgagtcggttggggattgggggggtgggggagttcggcgttgcggttcgggttggagggaggggaaattattttataatcggggtttttaagaggagtttttttatcgtttgtttttcggtgggagttcgcggttattttttttcgtgggtggcgttttttttgtcg

SEQ ID NO: 11127 - DNA, 2063 bp, Artificial Sequence
  Description of Artificial Sequence: Synthetic polynucleotide
tcgaggagtcgtggaatggaggattacggcggcgtacggagtatcggggaggaatcgtggggtgcgtaggcgtcggagcgttcgggttcggttcggatcgaaggtttgcgcggtgaaggtgtggtgtttgtgtttcggggaaagggttgttttttcgggggattgtttcgtagcgaggtttgttttgttcgtagttgggcgttttttggggagcgattgagcgtaagggcgggtcgggaggcgcgaggcgagtacgatgttttagggttttaaggattcgtgtgcgtgtgcgtgtgtaaagtggggcggtgtagggcgtgtgtacggtacgggcgagacgcgcgtcggtgcgggcgtcgggcgtcgtcgggcgtaattatagtataaagttcgggcgtcgcggggcgttggttcggagaatttatcggacgcgtagaatcggatcggtatttttttcgttagtattttaacgcggagttatagcgtttagggatcggagggtaggcggcggcggtaaaggatattacgtaagtttttacgtaattttttcgagtagtgtaagtttttaggattggcgcgcgtttcggttattcggagcgcgtatcgttcgtatttcggcgcgtttttcgcgcggtgtagggaattatagcgcgggcgggtattaaggggaaaggaggaggcgtggtttggtcgaggagttaatgggtcgggaggggcgcgcgggggaggagtttaggtgtagagtgtcgattggttagttcgtttttcggtatgtagatacggtgggagttacgtgttaggggtcgggacgattttttgttggaggttaacgcggggcggggaagggggcgcgagcgtttcgtttggttgaagcggggggaggggggtttttgttagttagagtaataagatggtcgcggtggtagtttcgtattttagcgcgacggtttcgggagtcgtagtcgtcgtcgtcggtttcgtcgtcgcgtagttttgagcgtcgttcgggtcgttttttgatagggtagttttagcgttcgtcgcgttttcgtcgtcgttatcgtcgtagtagtcgtgggttcgttcgagtcggaggcggagggagcggagcggtttcgcgtttagtcgttcgtagttgttatcgtcgtcgtcgtcgtcgtttaggattcggatttcgtcggagtcgtatttcgtcgggcgtgaggaggaggacgcgtcgcggcgttgtcggggtcggatttggatttgtcgggacgcgtcgtcgtttattcgttcgcgtcgtcgtcgtagtcgtcgtcgtcgttcgcgtcgggatttgagttcgtggcgtcggcgttgagcgggttttcgtcgttcgcgtattttcgaggttttcgggcggttgttcgtgtcgtcgtcgtcgttaggttcgcgttatcggagtttcgcggagtcgtcgtcgtcgtcggggacggagtttaggtgagcgcggtagttcgttcgtttttcgtcgtagtcgtaattttgtcgggaggttcgcgggttttttgttcggtcgagtcgagtcggggcgggcgttggtttttagcgattcgcgtgcggcgttaggtttcgggtcggtcgggtttgaggggagcggcgggaagcggtcggggtcggggcgcgtgtgtgttagtgtgagacggggttgtgtagacgttcggtgtgtattataattaaacgggagtggaatggagggttgaagatggatgtgtttttttttttttaaaatttatgtagcggtgaaattcggtttttttcgggtagtttttcgtagattttgtattggtgatggtaggcgcgaattcgtcgtgttttggtgtaggagttcggtgtcgttgtttgggggaagagaaaaattcggggcgtgttgcgggtgggcggagaaggatttttgggcgttttgcggttttgaaattaggtggattttttaacggtgttgcggattgcggagtaatgcgtatgaggaaaacgagtcgtataatatttgttttgttattagataacgtaattcgagcgtttggttgtcgtttttgttttaagcg

SEQ ID NO: 11128 - DNA, 816 bp, Artificial Sequence
  Description of Artificial Sequence: Synthetic polynucleotide
gcgttcggagtgggaggaggggaggcgttgttcgacgcgtttttttaagttttcgcgttttttttcggcggcggttgttcgggggcggtggttcggcgtcgtttttttcgatcgttttttttagggtttttttttcgtgtcgcggttaggttgttcggtcggcggcgcgttggaaatatgaagagacgttgtagttgcggtggcggtggcggttattgtagtttagagcggcgtatgcggcggtcggggcgggacgcggggtcgggcgcggagaagtcggggcgggcggtagagaggtcgggacgcggatcgggtcggggcgtttatagtcgttcgacggcgtttagagagcgcgcgtttcgtagtttcgcgtttagttcgtcgggtatggggcgcgcggtagtcgtttgaagtttcggtttggttcggtcgtattcggtcggaggcggagggtagagcgcgcgtttagttgttcgggtattaaatcggagcgcggcgtgcgggaggttttagagtaggattggaaatgttttggtcgcgtcgttttttgtttagatatttgttttcggtttttttgttttacggtgagttttcgagggttattcgagcgtttttagtcggcggaggtagttcgggcgtcgcggagttcgcggaggcgtcgggtttggatcgcggtacggtttatattgtttttttggcggggcgggttcgaggggagtttcgcgtttgtcgttttagttttgggagagggggttttgtttatttttcgaggtttgggatcgtttttttttagggcgttcggagttttttgttgcg

SEQ ID NO: 11129 - DNA, 368 bp, Artificial Sequence
  Description of Artificial Sequence: Synthetic polynucleotide
tcgttttttttatataggcgcgtcgggaggtttcgttttttggtcgcgcgattcgggtatttacgtttcgcgtagcgtcgcggtcggtttcgcgtagtagtattattcgtattatttcgttgtggtttatttgggacgcgatttataggggcgttgtttcgttttgcgggaagaggaggcggcggtcgtcgtgattggggcgttcggttttattcgtttatagaacgtttttaatattaggggtttgaaagcgaaaatttcgggaaggtattttttgatcgtagattatattttgtagttgatttatatcgtttaggaggtagtgagaaaagagggggtgtgtgtagtttacggacgtagacggtacg

SEQ ID NO: 11130 - DNA, 1411 bp, Artificial Sequence
  Description of Artificial Sequence: Synthetic polynucleotide
gcgggtttttatttcgtcgttaggagttttttttataattttgagaatcggggtgcgaagaaagaaagggcgaaagggtcgtttaatttttagagagtagttagcgaaagattcgaggggttttttttcgtaggatttcgaataattgtagtatttttttagttcgcggggtttattaaggagatttttataaataatagtatttgcggcgaaggaattattttcgtaaagggtagaagcgttagattttattagttaattatttagacgcgtatcgcgattcgtaagttcgggtacgtttcgttcgggcgtaggtagcgggaggggtcgggtacgttcgtgggggtggtttgggtacgggtttgattcgggggcgcgttcgggaggggtttgggtttgagtcgggggcgcgttcgggggagtgggttgggtttggggcgggggcgcgttcggaggtgggggagtttggggtgggggcgcgttcgtgggggtggggtggggtgtttggttcggggacgcgttcggggaggcgtggtttgggtttgggtcgggggagagtcgggtgcgtgttttgggtttgcgcgggggagcgcgtttggtgtttagatgtttggtatcgagcgggtgggggacgtcgggttcggagtcggcggtaagtttttttttggtaggtaataagttttttttgtagttttgaaggcgttttggttagggttattttacggttcgggtttttagagtttttttacggtttcgaattcgagtagtttttggtttttaattcgtttcggaaaggtcgtttttttttttaatgtgtggcgcgtttcgatcgttttttattcgtggaataaaagagtagttttcgcggagcgggtttagagtttgttcggattgttcgatggttttcggttttttgagcgtcgcggttgtcgggttttgtgttcgcgcggggggcgggaaggacggtcggggtttttagtgcgcgtttcgcggagcggcgcgcggcgttcgaattggaaagttgtcgtcggcgtttgtcgtttttacgtcgttttagttttttttcgcggggcgttttatttattagttaggagattgggcgtagggtcgtcggggcgggcggggggtttattttgtttttgatttttattgcgttgtaatcgtagaatcgtaaggtttgagatttgtgaaaatttcggtttatggtttcggtttcggttagtttcgtcgtcgttttcgttttttaggggtcgtagaaagattttcgggggcggcgtttttaggtttcggtttcggtttcggttcgcgttcgtttggtcggcgggttgttttcggtgttgcgggttcgagttgggttggtcgcgcgttttagggattttaggggtcgcgcgcgggaggagcgcgggggacg

SEQ ID NO: 11131 - DNA, 1487 bp, Artificial Sequence
  Description of Artificial Sequence: Synthetic polynucleotide
tcgtttttgtatttcggggacgtgattttttttttaggttgattcgtttttcgttttgtcgtttttaggtggaggaggagttgacgtatttttagaagaaattaaaagggatagaggacgagttggataaatatttcgaggatttgaaggacgcgtaggagaagttggagtttacggagaagaaggttttcgacgtacgtgtgtagggatgcgggagttcgcggcggggttaggtcggagtttcggggtcgggaaggcggggagagtcgtagggggaggaggaagaggaggaggagaaggcggcgttttttagcgttttttttaaataagtttcgaaaaggggtattttttagtagttgtggttagcggtgtcgacgttaggtttttttttagcggtgttgacgtcggcggttcggtcgggtgattttatcgtttcgacggtagtcggttcggggggcggggagaggcgggggcggttttcgcgtaggtaaaggtttggggggtcggggcgcggttgtgtagttttcgtcggagtcgagtttagtcgagcgttcgtcgttgttcgtgcgtttttgcgttttcgcgttatggtcggttttaattttttggaggcggtgaaacgtaagatttaggttttgtagtagtaggcggacgaggcggaagatcgcgcgtagggtttgtagcgggagttggacggcgagcgcgagcggcgcgagaaagtgagcgtttcggtttcgggtttcgtattcgtagttttttttttcgcgcgttttttttttttttcggtttttcgcgttgttcgttcgcgcgtagttttcgggtcgtttttttacgttttcggacgtcgatcgtcgatttatatttttgcgttcgtagttaggattttttatttttttcgtcgtttttttttttgggtttgggataggggagggggcgtcgttttcgggtcgggcggggtcggttaagcgggaaatggggggatggggcggagggggtgagcgattttcgggtggagaagtggagcggcgggagggggcgtatcgtgtaggtttcgatttcggggttggcgtcggggtttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtttttttcgcggtttttcggtttttgtttgtttttttgatcgtttttaggggcgcggcggcgacgtgtttgttttaggcggcgggggggatggggggtggaggaagtttagttttaagtcgttcgtttttttttagttgatttttgcgggaatcggggcggcgggattttgtttttttttagaaggtttcgggaacgttggcgcggggttttgaatttacgatcgtttgagcgtttgttgtgcgttttcgtcgcgagtcgtagggttcg

SEQ ID NO: 11132 - DNA, 602 bp, Artificial Sequence
  Description of Artificial Sequence: Synthetic polynucleotide
tcgttcggttaagttattttttcgttagtaggtgaggttcgtgaatagttaagttttttttggtacggcggaatcgtagtggacgcgtggaggggtttcgtagaggagggatttttgtttgggatgcggggagttgtagttttttatttgtatttagtttgttagttgtacgtttgtaggattataattttagtataaagtaggattgtagggcggtgcggatttttggagggagatagcgcggtgcgtttttgtcggttatgttggttggggtggtgttttaggcggttttagtcgttagttatagggcggtcggattataattttagtatataacgggagtggaggtggtgattttgagagagggtttgtgttgtgcgcgtttcgcggggtatgttgggagtagtagtattttagttgttttcggtcgttggtcgtagggttgcgggattataattttcgtatgaaatggaagagagggtggtgcggatagtttgaggaaggtacggatattttgagggaggtatggatacgttgagggaggtacggatacgttgagggaggttacggatacgttaagggaggtatagtagcggtgcgcg

SEQ ID NO: 11133 - DNA, 628 bp, Artificial Sequence
  Description of Artificial Sequence: Synthetic polynucleotide
tcggtattcgtcgtattatagcggatgggtgtatgcgggcggtgattcgagttcgcgcgggttgcggaattttttatttattaacgtcggcgtcgttatgggtttagggggttgggtgaggtcgtgagagtcggcgaggaagtcggttttgcgggttcggtcgatttcgggtttcggttttgggttgcgagggattttagttttcgtcgtcgtgtaaaatgtatataaggttcgcggcgtcgtttttgcgcgtcgtgaggatatagggttgtcgttaaggttttaggaagggttttgtagacgtttgtgggggtgggatcgcggttgatataaaagcgtgtaagtgggttttattttttttattgttcgtttttattcggtttcgaaaagtggtttttgtttggcgttttatttagtgtagcgttggtaattatagtagtcgtaatttaacggcggacgaagattggacgtcggaagtttcgtttacgtcgttacgggaacgtttttttgcgtttttcgtttatggtttggggtcggttttcgttttttgtagtattgttttttgggtaatgtagtttgacggaattcgggtggtatttggagcgtattttttgttttcggtgaggcg

SEQ ID NO: 11134 - DNA, 215 bp, Artificial Sequence
  Description of Artificial Sequence: Synthetic polynucleotide
acggagggacgggtcgtgtagtgtagtcggcggggttagggttaggtcgagggcgcgaggtggtagtcggttcggggaggcggaggttgagcgagcggtggtgtttgtggagttgtcggttgcggtggaattatgaaaaatagtaggtatcggagtcggtttttagtttcgattaggggagatgggatatgataggtgcgattaatacgtagtcg

SEQ ID NO: 11135 - DNA, 2638 bp, Artificial Sequence; identical to SEQ ID NO: 6376
  Description of Artificial Sequence: Synthetic polynucleotide

SEQ ID NO: 11136 - DNA, 2172 bp, Artificial Sequence
  Description of Artificial Sequence: Synthetic polynucleotide
acgggatgtcggtttcggtcgtttttattaattgatttatgatcggtttggttagggcgttcggtagcgagagcgtcgtcgcgtcgttgggaggtagcgttagcgcggggaagaacggcggttggtgatttagtatcgcgtttatggcgaagttcggcgttcggtgaggtaggaacggatggtaggttatgtttgttttaggaatgatcggattttttatggagaggtttatttattttaggcggggcgttgggttttagtcggggataagttcgtagttgttgtgttttgttgtttttttgttgttgtttaatagtagtatataatttaaaaggggggaaaaagtaaaataaaaaagaaagaaaaaagaaaaggaggtagaaattataattaatgtattttaaagggaggaggggaagtgttttttggagaatgggaggtcgtttttaaagagggtaaggcgaaaaattagtaaatatagtcgcgcgggtgatcgtttttgtgttttgcgtttttaaaaagtcgtttttgaacgtcggttttagaagcgagaggagcgagtagggtttcgattcgcgttcgagttttgtcgttgagttcgaaatagatattttagttttgcgttttaggaatttttttttagtttttaggttttttgttgtaaatgtgaaaggtttttttagaagattttttatttttttttttttttttttttcgttttttatttgttttttttttttttttttttgttggtggcgtttgtagttgtgttagattcggttttaatagggagcgagagagcggaaaaagttttttttttttaaaaaaaaaaaaatttgatttaaatttttttttattagcgttattaaaatttgaattgtaaattggttttcgttcgtcgtttttttttttttttttttgtttcgagttttcggagggtgtttcggttttaatttaaattttgttgggtttttttttcgtgttttttttttttttttgttttaaaacgtgagcgaattcgttttttaaatttgtgtttaggcgcgtagggtagggaggatttagagggggaaaaaatggaatagagggaaagagagggaggggagagagagagagagagagagagacggagtcggagagggagggagcgagagaaagcgagagtttttcgttatttttcgtcgtttttagaatttatcgggcgtttgttcggcggttttagaaggtcgggttgcgttgtgggttgcggggagtcggaggttttttgattggttttttgacgttttcggattaattgtgttgttgtataggcgtggtttttataggtcgagtgttgggggatagagttgagttataaaaagaaggtgtcggaaattgtaacgtcgtagcgtcgtatcggtattattgtttgttttgtgaatatgttaatatgattagagggcgggcgggagttattggggagcgcgcgcgtatagagtcgtttttaggtggtttatcgagagatcgttgtagtttttgagttcgttcgttcgttttggtttagtttacgtttgaaatgttttagttatttagtcggggattgagggaggaggtagggttaaggaggaagggggagggagagagggagggagttagcgagtaggcgagtcgggcggggaaggcggagagcgcgttcgggcgtcgggtaggggcgttcgttttttttgtatttcgttcgttttttcgatcgtcgcggtcggttttttttttagttttttttttttttttcgtttcgggcgagtcgggcgggtggtcgagttttttcgcgagttgttattcggttattcggttttataaaagtcggcggtagtcgagaagcgagcgtcgagattttaggtttgcgtgttttttagttttacgtggagttaagtttcgttcggtcgtcgttgaagggttttcgagttcgggtgtttcggtgttggttttttttgcgtttgggttgggggagtataaggatgcggttatattttagtatacgtatgtgtgggttttttttttattgcgttttattcgtagttatgtgcgggtatttaaatattttcggtgtatttgtattcgaatacgcgttaatatattgggattgaaatatatatcgaaaaatacgtatatataaatacgtatatagtttgcgcg

SEQ ID NO: 11137 - DNA, 2548 bp, Artificial Sequence
  Description of Artificial Sequence: Synthetic polynucleotide
tcgggtgggtttcgaaggcgaggatggttagaatatgtttttcgtgatattttttgtttttttttagggtcgtgcggcgagaggcgttcgagtattgttaatgtgacgcgggtttacggtcgtatcgtggggggtagcgcggcgtcgttcggggtttggttttggttggtgaggttgtagttcggcgggtagtttttgtgcggcggcgttttggtagcggttttttgggtgtttacggtagcgtattgttttgtagggtaagtaggatttttaggttttgtttagttggggttttcggcgttgggtttcgtatttgtcgggttgttcggcgggcgacgcgcgggaaaggtggtttttgttgttttttggcggcggtcggtttcgggtttttttattttaaggcgtcgcgttcgtttcgttaggatgttagttcggagggggtggtacggtcgggcgagttcgttttttttgggacgggattttttttcggttcgtttttcgtgtttttaggtggagaaagttcggtatgcgggcggaggggtagggttttcgaggggtttgcggggtgtgtttttgttttttttgcgttttagttgtcgttcgattcgtagcgtttcgaatgagtttttgtggattgtgacgttggtagaggggtttcggggggagtaagcggaggaggtgttagtgaatcgtattttgttttattttaaggtgagaaggtagtttttaggtttttaaggttgggtatcgtatttttattcgtgtttttttgattttgcgtcgtttttttttttttagtttgattcgcggattttttataacgatttggttttggtgtagttgtggacgtcggtgagttcggggggatcggcgcgtttcgtgtgtttgttttaggagttttaggagttttttgtcggaatcgtttgcgttatcgcgggttggggcgtttttttcgaaggtattgggcgtgggtgagtcggcgcgtggtgggaagaattgggggttcgaggtaatagagtgtagggaggtcgggttgttttggaaaaatgttgtttgtttttttaaagggggaggaattaaggggggtggtgggaaggggatttttaaggcggggtttttgttttttaaatttgagttttttattttttttttgtagacgggtttgaggttgaagtagtgagagaggttcgtgtttttttgtttagtatcgatatttgtcgaagagttttggggttcgggttgcgttttagtattatgttttgcgtcgggtatttggcggggggcgttgattcgtgttaggtatgaatttagtttgatgagaaaaggtcggttgagtttttttagggttattacggttttttttttttttacgtttgtttgttattcgatttttttgagtttttttgtttttatttttaaaatggatataagtggtaagtttatatttgttaggcgtaaggtaggcgttatagggggtaggtgaatgtagcgtttttttttttggtttcgtagggtgattcgggaggttttttgatttgttttgagtttggttttcgttttagagaggttttgttcggagttattttttggggggacggttgcggggagttagggaagttcggggtttatattcgcgtggtagtgtttaaggattggttttaggagtagatgagcggtgagcgttttttttttaatgtttcgtttttagtgttttaacggataatcgtgggataagttcgtttttattcggtttatgtttatttttagtttttttttgtttcgggaaagtttgttttttttcggggaaggagtgagggggttagggttttaaatagagggtgagttgatttttgtttcgttcgtagtagttttttttagtcgcgagtttagttgtagggagtttttggtttgggattttttttaggagttgtaggtagacgtcgttcggttttgcgttttttatgttcgtttgtgttcggggttttagggcgtttgtgcgcgtttggcgtattagtagtgtttgtagcgtcggcggcgatgcggttagttttgtttattcggattcggacggggggtagaggggagggggtttggttagtttttgatcgtcgtttcgatttttgttcggttcgtagagttgcgttcgttggcgtatacgttgttgggtttgttgcggaacgcgtaggagttgttcgggtttcgttcgggattgcggcgtttggttttcgttttggtttttttcgttttagcgtttagggagttttttttgtatttcgttcgggagttgcggttttatttaggtatttcgcgttttttagtttagtttagttttggttcggttttattcgcgcggtatagttatttttttcgtcgaggcggtattttaattttgtgtttttttaggatcgcgggttgtaggtattcggttttcgaagcggaggtcggagtcgcgcggagaagttaacggtaatgacgttttttgtcgatttttaggaggggataggttgagggtttggacgaggtcggaagcgtttttattgtagtttcg

SEQ ID NO: 11138 - DNA, 919 bp, Artificial Sequence
  Description of Artificial Sequence: Synthetic polynucleotide
acgggagtcgttgtagggttaggacgtaaagatttcgaggttttttaggtcgaggggacgtcgttttcgttttatttttgcgttcggtaggtttttggtttcgttagtatttgtcgtttagggttggatttacgcggcgggcgggtgaggggtttttggcgcgcggttatcgttcgttttgtgttaggtgcggtgcggtagcgggagcgcgcggagttcgaattttgtacgtgtggtttcgtcgggtcggtcgttgcgagtttcgtttcggtttcggttatcgtcggggaggacgacgacgacgtggtgggggacgtgttggtattgttggtcgcgtttttggtttcggggtcgcgggcgtcgcgcgtggaggtcgtttttttttgtcgtttgcgtcgggacgcgttggtggagcggcgcgcgttgtacgagtttggcgtttattatttggtgagtgtcggcgcgcgggagggcgggtgagttcggtcgggcgggagtcggggtgattattcgtgtttttcgtagttcgacgtcgagggtgtttttcgtcgcggttcgggtttgaatttgattagcggttagtatagggcgttcgtggttggtttttacgttttcgtcgttacgttgtacgtgggtgaggttcggggcgtgggaggatcgttcgttttgtcgtttatttcgtcgttcgttcgtttgattacgttttattttttttcgtagcgttcggggagtcgtcgaggagggggtcgtcgcgttttcgggattatttgcgtttgtttatttgtatttagtttcggtgttagcgtaacgcgtgagtgtatttcggttcggattttatattcgtattcgttcggtttttataagttggaggtggttaaataggtattggacggggttttcgttcgtttatattttatcg

SEQ ID NO: 11139 - DNA, 2488 bp, Artificial Sequence
  Description of Artificial Sequence: Synthetic polynucleotide
gcgtagttcggtaggggcggtcggattcgggtaaacgtagtttcgggtgggagtagggttatttttgttttcgagcggttggaataaaaatgcggattgtattttttttttttttttatttaaagtgtttagttttgaagataaggtggagggaggagagagagggcggaggtgtaaatttaatttaatttttgcgcgcgttttcgaggcggtcggttgttttcgtttcgtcgtgtttttttattaaggaaggttttttcgttaggggtcgttaacgttcgcggttttcggttagacggtgtatttgagagggatatttcgttttttttcgggagggattcgggtttgttgaagtgggtttaattttgtaaatcgcgttttaatttttcgcgtcgcgtcggggaatttttttttgatatttaacgtttttcgtttttatatttttaaatatagtttattttttttttcgtggcggtcgcggtaattcgagttcggttttcgtttcgtcgttagagaacgtttttttcgtcgggacgcggtgtcgagttcgttgtatatcgagcggtcgtggtataatatcgcggcgttgcgcgtataattatcgttttttaggattcgcggcgcgtatttcgggagtggggtgcgtttcgcgattttgggcgtttagggttagatatattttttgggcgtttcgcggtttttatagtgtagtttttatcgttttttttttattttcgggtatatttattcgtttttcgttttagtttattcggtttagggcgtagtcgttttttcgcgtttttttttttagtttcggtaaaggaagttttttttgcgtttttttttttagaatcgtttttagtttttcgtttttttaatcgtagtttaacggtcggcggtagtagtcggagaaggggggcggcggttcgggtttcggaaacggttcgatcgtcgggattcgggtcggatttcgtatttgggttggaagcgaggcggagatgggcggtcgggattcgcgagtgagcggggcgggcggcggtgatagttttatagttttagttgttgttgttgttgttgtcgtcgcggttgttcggggagaggggttggtattatcgcggcgcgttattgttcggttcgggggcgggggtggttaggaggagggtttaggcgagtagcggcggtagcggcggcggcgtcgcggttcggaggaagggggagggggtatcgggtacggggaggcgggagagggggcgggatcgggtacggggcgggggcgggggggaggggagcgtagggagggcgtaggtagggggagtaggaggagtagtaggaggaggtggcggaggggcgggtgagagggaggagtgggtacggggggaaggggagagaggaaaaggaggtatttagggagaggggagaggagaaaggagggagagaggcgcggggggagaagaggaggaaggagggggagttgggttaggtagggggggataagggcgcgttggacgcgtcgtcgtgcgtttcggtggggagcgcgtttttaagggggaagcgtttcgaggaagatttttgtacggggttgagttcggaaagaaggcgttgggatttgtgtttatttatcgttttcggaggttgcggtttttgggttcggtgggggttggggggagagggtattcggcgggttgtttgcggttaggttaggagagggagatttggtttaaataaagtgatttaggtatttttaggaattttcggcgttcggggttttttcgggtagttttcgatttttatgcgtttttcgggtttttagggacgcgggtatttgtggggcggggttgtcgggtttcggggttcggttttttcgggcggtcggagcgagatttcgggttgggaaagttaggtacgtggtcggttttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgttttttgcgggtattcgagtgttcgggaggcgtttatttgttcgatttaaatatttacgcgatttttagcgttcgtcgttcgcgtgttcgttttcgtttcgtcgtcggttattgtgtttcgttagtttatatcgggtcgggttttgacggcgcgcgagttatagttgtaaagtaataggataatttcggggacgtcgttttagtttagattcgggtacgtattgttcgtggagacggtatcgtcggggaggggagttacgcggattttagatgcggttttttaggcggatagatttttgttcggggcgtaggaggaggtaggattggtatcgcggggtgggagttttggattttcgagtaatttcggattcggttcg

SEQ ID NO: 11140 - DNA, 513 bp, Artificial Sequence
  Description of Artificial Sequence: Synthetic polynucleotide
acgttgttacggtaacgattgtacgcgtatttttggagggtggtttgcggttttataggtttcgcgttcggggaggagaggaggtggtcgattagatcgtgggttttcgggtttttcggtttttttaggttttaaattttttttattagagattttgtttggagtttttatgttagcgtttttttttatcggtttttttttttacgtcggttttagtgtattacgcggttcggcgagggattgggaacgggatagggacgcgttttaatttatttagcggtggagttggggggcggcgcggttacgtgggatggcgggtagtttaggggattcgggcgacggggtttggcgggtagggttgttttagtcgtttttataaagtcggttttttcgatttttttttttttttgtagtttttttttttttttttgggggttgggaggggacggggcgggacgttggtagtcgggagagtggaaaaggttgtatagagtttcgtgataagttcggtcg

SEQ ID NO: 11141 - DNA, 1766 bp, Artificial Sequence
  Description of Artificial Sequence: Synthetic polynucleotide
gcggatggtcggtttaggcgcgtttttttattcggggtcgtttgtgttcggtgtgtcgtgttcgcgggttaggggcgcggcgggaagttttcgttcgttcgttagttagcggggttaaataggttatttttttgcggacggtcggcgtcggagtttttttttcgttcgttcggatttattttcgtaagtagcgttggggttggagtcgggcggttcggattagtttcggtttatttgggcggcgttcgcggtcgggtttacgtcggggaaggtttcggtcgtcgcgagttttcgttcgagtttcgcgttttttagttatttatttgttttttacgttttatttattagcgcgtacggtttcggtaattttattcggagcggggcgtcgtcgtcgtttttgtcgtagttcggtcgggtcgttgggcgtaggggatttcgcgtcgtcgttgtcgttgtcgtcgtcgtcgtcgtcgttgtcgttgttgtatttttcggcgagcgttgttgtttttttttttgtttttttttcgttttttaacgtcgtcgttatcgttttcggtttttttttcgcgcgtcgttttagttaaagttcggtttcgtatttcgttcggatcgtttttaaatcgttttagttcggtcggttacgttgttttagttagttttttggtacggcgttatcgtttttcgttcgtttgttcgtcggtttttacgtaggggaggcgggcgcgtttcggggcggggagcgtcgggtcgggagtcgcggacggttggggttcggggcgcggggggtttagtcgcggtgtttttttcgagtttttcgcgcgttagcgtttttattttcggtttgggggacgcgcggttcgcgattcggttttgtttgttttcggcgtacggtttcggtttcggtttcgaagtttagtttcggacggggtagtgaacgtagagttggggtttcggcggttttcgatttttcgatgttttcggattcggttggtcgcgttttcggcgtcgagcgcgtattttcgtcgggatatatagacgtatatttattcgatatattttcgtttttgttcgttttcggcggagagttgaaatagatgtgggattcgtttaggagttggaaacgagggagggaagcgagttagagttttgtgtgtacgtgtgtgtgcgtaatatataaattagggggtatcgttaataaattaaatatcgtgataaatttaggagggttatcgattaggtttatttggttggaaacgacgtgaatttgtttttttttcgtttttttttttttttttttcggagttggagggagttaaatgtttcgcggggagtgcgatagtttcggtcgggcgtttttttcgtaatgatacgttaataaatgtttttttttatttgtttttataggattcgtttcggtttgtaaatattcgattgtttttgtcgaaagtttcgcgttcgtttttagttatatatatttgttattggagaggtcggcgtcggtcgcgattcgtagtttaatcgtagggtaaatcgagttgtttgtgcgcgttcgagaatttttcgagaaattaatttcggtttaagtgaaaatagtagttgttgtttagaaatggttcgggagtagtatagaaaggagaaatcggtttttttcgaaaggggaggaattggatttaagggggtgttgtttatcgtggttttcgttgtttttcgcgttatagaagaggtcggagggggatcggtttgacgcgggtgggtaaagagcg

SEQ ID NO: 11142 - DNA, 6511 bp, Artificial Sequence
  Description of Artificial Sequence: Synthetic polynucleotide
gcgatttcgggggttagtagagaggagaggttgcgggaggattcgttgcgaagggcgaggggtggcgttgggtgggacgggcgtttggggtcgtgtagggtggtttttgggtgttgttcgggttgtttgtcgtttagtattggcgtaggaagacgggttcgcgtagcgtttggtaatagtggtttgttttacgtttggaggcgattaagttttgagttaaaggcgtcgggtttagtcgggaagtgtatggcgatttagaatacggagcggagaaggttttaggggatacgaggttatcgttttagttttcgggtttgcgtttcgagcggttagggtgcgtacggatgggtttcgggatgttagtggagaggtgataggagtttattattttacggttaagcgtgtgaggttttcggcgggcgggggtttttttcggggtagggtagggggagagttaggtatgtttttaacgggttttttagtagaatcgttaggaaagtggtttttaattttaggtatttttgtggtttttaggtagttgggcgattaaaaatttatttttgtttgttgtgaaatgggataggtggttgttaggttagagattgtgtttacgaagtttcgtttggcgggtcgggattgacgtggattcgggtttttttcggaagtttgggaatttgtgagttttttagtttttcgttttattttgtttgtttgaaaaaaggagttgtttgagaggaagagttaaggtttaaaaggttttaaacgaagagtatgcggtttgacgcggagcgtaaagaagcgagtagtgaattgaatttggtgggattgagattagaggcgtttgtatgcggcggtcgtttcgcgttttattaaagtaatttgttatttacgataattatttttgtaattattttggagtggttgtgatttgatgtttgtggtgttttagggtatgtttttattggatatagatattttagggtgttttttgacgttagtgtcggtttagtgggtgttagtgtcgcgaagggagggtggcgggcgtgaatgttttttttttttgggtttgtcgtaggtttcggtttttttattttgtttgattttggcgggtttgttatttattgaggtttttatcggcgtttacgttgtttcgagaggcgggataaacgttcggcgcgtggcgcggagtttgcgaaagcgttcgggggtttttattttttgttcgggagttttttttttggggcgggaagaggagtcgtagatttgttcgaattttgttttattcgtttggtcgttttttttcgtttggggtgggggtaggggtggcggatgatttaggtttggggtcgggagttttgtttttaaaggtattatttcgcgtttttttggaagtggcgcgttgttggggcgttttcgttgttgtagaggtttggtttgcggttttataggggcgtgggtttagggtttttagggagtaagtgagtttaggttttttagggggcggtagaggggaattttcgataattttttatttttttttttaggcggttgcgaggttttcggggttttagaggggtttttttttgtcggtgtcggttgttttgagcgcggttacgtagttcgcgtttttacgtgggtaaggggcggggacgttggagggaggttgttttggatgttggagttttcggttttcggttttgttgagtagaaaagttgaagttaaggaagggttgaggtttttttataagggcgcgcgcgtgtttgggtgtcggtttagaagtcgagaatgtgcgtattggggaagggtttttcgtgtcgagaagatagaggatttgttttagttgtttttcgtatagagggcgcggaggttgcgttttagttcgaacgtttatttattggaaagagggtagcgtcggggtttagggaagttttttgggaatgaatggtttttgttaagcggtttcggattttttgggttttttgggtttacggtacggtgttgcgcgagtttttagtgtttatcggtttttttcgttttttgcgtagacgtttttaggcggggaggtatatcggttttttcgggtagttttggttagtgttgttgtgggaaaggagagttagggtttgggatgggggatgagtatttttttgtttatttcgggttttagcgtgtaggaggtaaatttgttagtatagataagatagtttgtttaagttgtattttaggtcgggttagagaataaaatcgagggttagaaggtttagaatgtcggatagtttagcggtattcgttagggagttttaggcgttcgaaagaggcgtcgtatttttggcgagtttaggatttatttttttggatttgtgttttggagtgtttgcgggtttgggtttaatttttgtttttggtaggtgtttttttttttcgtcgttaatattaggagcgttgtttttgcggtaatttattttatttttagaagtttgttttgggatcgaagtgttagggttttgtgtgtttttttatgtattgttttttttagtgtaaagttttgtagatatgtttggtcgaaaagttttagtggttttaatttttagattttgttttcgcgttcggtcggaaaattatttgggatttggttgttgtttaaggtcgggggaaagttttttttggaggacgtttattattattatttttttttaggtttatttgggtttaaataaatgttaaagtttaaacgaattcgagaaggaatagcgaggtagtggatgtcgttatttcgtggatgggagagttatgtttattgtaggtgcggatatcgtattgataggtattgattattgtaaaatcgtatttagtattaaatagaaatagttttgttttttaatttttatagaatgtttaaatttagtttagggagttagttggggcgttttaataaatacgttttcgagaattagcgatgttttttttataatgaaagttaattgttgtataataattgggttaaagaatttcgttagtttaaattttaaaaattagtattgtattttgtttttaagtttgggtggtaagtatcgaaggggagagggaagtagcgtttgtgtggaaggaagtttcgttttttgtttaaatatgtgggatttgggtgtttatttttttagtcgagagttttttgtaggtttttttttaattttttgtatttttttatttttattttattcgtggcgttcgggttttatttttgttcggcgttttttttttagggcgagtagaggtttttgagtgatcggttcgttagaggtagttgtagagtcggcgtttcgtagggtagggtagggtcgggtcgttgggttggtttagtgcgcgcgggttttttttggttttagttagtcgcgggagatgttatttcgggcgatagcggcgagacgtcgttgttcgtaatttttgggcgggtaggatcgtttgttgtttttgcggtttttggggtagattttttaggagttttttttttttttttttcgttcgggggtcgggatcgcgttgtgtttacggagggaattgggcgtttttggcgtattggggttttagttgtatgattttagtttagattttaagttttagtggggtgtaggtgggatgggatgtgtttttaggagatgaggagatttcggttgttgagtcgttttttaaatgcgtagttttttaattttaggtgatattcgttttttggaggaacgagtgaaggtcgtttaggcgaaagaggggtgggttttagtatttggatttttttttttagttttgttaattttaggtgtgtttacggtggaggtgatagaaggaaggcgcgtcgggggatttaggtttcgtaggttttcggttgttaacgaggtatcgtttattgatttcgcgtttcgttttttatagcgtggggttcggcgttgcgttaggttcgggtgcggggcggagttaggttgggattggttgggggtcgtttcgttcggcgtttgggttttcgcgtcggttttcggggaggagttatgataattttttttttattaaggcgttcgggtttttcggttatcgttaggatatattgttcgggcgcggtttttttcgttcgcggagcggttttgatattcgcggcggtagtatttacgttcgtagagtcgtcgatgcgtgtttagtgattcggatagtaaggttcgcgcgcggcgggggcggcggtagacgtttggttatcgtgatttcgattttggatttatcgtttgggggttggggggattttggatttaattggcgattgttttgggggacgtcggacgttatgttgtggaaaataatcgataatgttaagtacgaagaggattgcgaggtgagttggggtttcggggtgtagtttcgtttcgtcgaggatagttcgggaggtaggggttattggatcgaggtcggggacgagggtataggagttttggtttttcggtgggacgggatttattttttcggatattttttagtttatttttgcggggttttttttttgtatagggtttttttttaaatagttttttttcgggaacgaggtttggaaagagaatggtaaattttatttatatagtttatcgggcgtttttttaagcggtaaatagttttgtttttcgttttttcggaaaagtgtttcgtttgtaatttttagacgtggtttttacgtacgaagtttttgtttaaaggggttagatgaggttatttgttagcgatattttggcggatatttttttaaggtcggtttgttatttgtttcgttattttttcggggaagtacgaaaataatcgaagtttggtttttaaaagaagtgggggttggggagtggtggtgggggtgttcgaggttagatggggtcgtaagagttcgcgagtgttttagtttgtcggataggttgagttagagtttcggagagtgggagggaagaaggaggcggcgagcgggaagaggaagaagacgtaggtagcgttaggcgagtttaggggcgtcgggagcgcggagttcgggttacggattcgcgggagtttattgcgttttcgggttttggagggttgtttttgttcgtaggttcgggcgttttcgttaggaggcgatagcgttatgtttttttaggttttcggcgtttcgagatttttgggtagatggggacgtattttttagaaattgagtcgggtcgtttaggggcgagggaacgtgcgcgggtaaggttgtttaatttttagggttttttatgttttttttgcgtttcgacgtgcgagaatattgtttttggtagtgtagggcgtttttatttattatttttttcggttgggttcggttagtagggagggtcgttttgtgcgcgcgttttttttttattttttagggcggcgtagggtggcgggttttgtttttcgagcgtcgttcgttcggaggtttttgtttcgagggcgtggaagggagggtttcgggggcgggggaggtgcgtatttttcgcgtcgcgtattttattcgcgtttgtcgcgttgttatttttagtagtttttgcgttatgggcgggttttacgagatagttttgtatcgggcgttcggttttttcgtttcgggttttggttttttcgtttcgggtttcggttacggatttttttggtttaagatttagggttcggatttggcgtttttaagcgtttcgggtttgggagtagcgtttagattttcgtcgtcgggttttgagaattcgtttttttaggttttttattagattttttttttttttcgtattttttgtttataacgaaattttcggggcgtattgttttcgggtatttttcgattttgggtaagtttcgtcgggcggggtgcggttggtttttcggggttttttgcgtagttcggcgatgtcggttagttcgtagtagcggggtttcgtattaacggggttttttgtttttttttttttttttaggatcgttacgacgggagtagtaatgggaattcgcgggttttttatttttttttcgtcgggtagtatttttatagtttcgcgttattttttttttatattggagtcgtcgaatattagtcgttattttattttttttttttttattagtagttggtttatttttagtcggtcgatttttattcgtatttgggggaagcgtacgtcgtcgttattaattttttgtattagtcggcgtttataggtagttagtagtaggtttggttcggtcgttagagttaggagggagcggggttgttttcgtattacgggcgttcggtcggtttattgttttattttttcgggttggaggcgggcgcggtgagcgttcgtagggatgtttatcgtcgtttcgatttgttgttgttttacgtatacgttttggatgtcgcgggtttggtcgagaatttggggttttacgatatgttttattagatggacgaggtgtaggtgagcggcgttgcggtttttgatcggatttgtttattttacg

SEQ ID NO: 11143 - DNA, 6511 bp, Artificial Sequence; identical to SEQ ID NO: 11142
  Description of Artificial Sequence: Synthetic polynucleotide

SEQ ID NO: 11144 - DNA, 338 bp, Artificial Sequence
  Description of Artificial Sequence: Synthetic polynucleotide
tcgtttttcgcgtatgcgtttaggtcggttcgtaggtttttttcgttttagtcggtagttagttcgttcgcgttggggttatcgcgagtcggttcgtagcggggttatcgcgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcgcggattggaggttttcg

SEQ ID NO: 11145 - DNA, 936 bp, Artificial Sequence
  Description of Artificial Sequence: Synthetic polynucleotide
gcgttttgttcgtttattgggtttttcgtcggtttatttgtatggttcgaggggggcggggttgacgtcgcgttgggaatgttttggtcgagatattgaggtagggtagagagcgtttgcgggcgtcgggcggagttgttgcggattaggattcgagtcgattttcgatttcgatttagattttaattcgcgttttcgtttcgtcgtcgtcgttatgtacgacgtagagcgcggttggagtttgtttttcgcgggttgcggttttttgggtttttattacgtcggggcgattcgttgtttgagcgagtacgtttcgtatttttttcgcgacgcgcgtatgttgttcggcgtttcggtcggggcgttgtattgcgtcggcgtttttttcggtatttcgttgggtgcgtttggggacgttgttcgggttttacgtgcggagtgggtgttttttaggtcggggagcgggggatttttaggggtcgcggggttttggaggagcgggtatcggacgcggatacggcggggtgtatttcgagggtttttttcgaggtagatgttttttgcgggggcgttgtttttgggttcgggaagggggcgttggaatttcgagcggttcgggtcgaagtttgggattttcgtgcgtttttatttttatttttattaggcgttcgtgtatgaagggagatttttattttcggattgagagtcggagcgtttcggagcgacggggagtagggagcgggattcggggcggagggtagtgttggtttttgcggatttcgggttttttgtgttttttcgggaggggttggacgggttgagttgtcgaggggtcgatttgttttgggtcggataaagagtggggttttggtcggttttttacggtgggttttttttttttggggattgagggatttaagatatttcgcgtttgcg

SEQ ID NO: 11146 - DNA, 2184 bp, Artificial Sequence
  Description of Artificial Sequence: Synthetic polynucleotide
gcgcgtttttttaatttttttgcgttttagttttttcggttttagtattttcgtgatttgagtatcggcgggtttttgtttattgtttagtattcgacgtatttgttttcgtcgcgtagtttttttttttcggtttgagtttttttttcggcgcgtattgtttttgtgatttttttttttttcggttatagatgtagttttcggttagaagttttattttttcgaggttttcgtttttgttaggtagtttttttgcggcgtcgtttatttagagttttttttttggacgtttttttagtgtttttttagtagtttcggcggttttttttttatttttagtttttttttcggttttttaggaaggggttagattttagtttagtatttagcgttttttggttttttttttttgggcgttttttcgatagttttttttagggaagttggttcgttgcgcgtttttattttcggtcgtcgtttggatagaggcgcgtaattcggagggcgtaggtttcggttcggagaagggggtgtcgtcggcgtttcgattttttaggaatggggaaatagaggtacggtggattcggcggcggggttgggtttggggttggacgttgatttaggatttcgtttttgttcgttttgcgtcgcgtttttttcgggtcggttttgatcgagtagttttacgcgggttcggggttcgtttattcgataggagcggggggttgtagtttacgagtttacgagttcgtagcgacgtattcggagtgtaatttcgtagagttacggagatattttttcggtgtgggcgtttcgtcgcgtttttttttcgcgggttgcggttattttagggtaggatagagtcgagatgttcgggtgggagcgatgttcgcgtgggggcgatgtaacgggggagatgtttggggggagggtggtaaggtgaaatttggtggagaataatgggggtgggtgggcgatttttggggaggtgttcggtgtggggtgtttttggttcgttcggggatagtgcgcgttttttcgttcgcggcgttcgttttgttcgttttatcgaggtttttcgggagcgtttgggtttacggtttcggggggttttttcgagatttgggcgttgttttgggggagtaggggttcgggttattaaggttcgtgcggatcgtggggtgttttacgtttaggtcgggggattttagagtttcgttttttttaagggcgtcgcgtttcggattgtaggtggagacggggatcggtttcgcggggtcgtcgataggcgcggggcgggatagggtgggaggcggcggggcgtagagtttttcggtcgtcggcgcgattcgggtatttttttggaggcggcgggagcgcggtcgcggcgttttcggggtggggtttaggttggaggtttcggggcgtatcgttttagttttatttcggtcgggttttcgcgttgtttttgcggagagggaggaaggaaggaaggtagggagggaggggacggtcggtaggcgtggggttcgcggcgttagggtttttttttttcgttcgttttattttgtaattcgtagttcgggcggggtttcgttgtttttttttcgaatatagtcgtttttttttttttttttaatttcgagcgttttttttttcgaatgcgggagtttatagtgtacgggaagtttttttttttttttatcgaggttgttcgacgttttttttatttttcgatttttcgtaattattttttaaatgtttcggcggttagtagggttggggtgggcgtaggagaattaggggttttgttcgtatgtaggggtttggggtcggtgtggtcgaatgaacgcgcgggtttagacgagtttgtgatgttttcgttttttattttttcgcgatttggttttagaagatagtttgagaggtcggtggtcgcggattttggacgcgttttttttttgtttgtggtttttttttatttcggtagcgttgtgagtttattttttatttataggagttatatttagaatttttttttggggttatagcgtgggttttcgatatttgtgtgattttagttttgtttttttagggttgcgtggtgaagtttttaggatttttcgcgtgggttgggcgggtgacgtggatgagggataacgtggtgaggttttcgtcgtggcg

SEQ ID NO: 11147 - DNA, 413 bp, Artificial Sequence
  Description of Artificial Sequence: Synthetic polynucleotide
tcggggcgtgggagttgcgttcgtttttttttttcggcgtttcgtggagatcgggaggtttagcgttttttttagtttttagcgtcgtttttttagattttagagacgtcggttagggcgcggcgtttcgggttattgcgggtttttttcgggcgggcgacgtggggggcgaggtatcgcgcggcggcgtttggcgggtattgttgttcgcggagggacggtgggggggttttagtagttggcgggggtggagggggcgggagagggagtttgcgtcgggttgagtttggaggtgcggggcgggttcggggagcgtttttggggttttttttgttatagtcggggcggttggaattttttttttttttttttttatttttttattttttttgttcggtttcgtcgttaggtcg

SEQ ID NO: 11148 - DNA, 403 bp, Artificial Sequence
  Description of Artificial Sequence: Synthetic polynucleotide
tcgtttagtttttgcgttcggaagaaaatttagcgtaggtcgggtttcggcgcgcggaagttttgcgaattttaaatgtgtgcgttgagtcgaggtttttaagcggtaggagagaatttgattttcgatattttttttaagatacgcgtcggtggatcgggttttgggattggtttattttcgggttggattttggggttcgtatatttgaaagcgtaaatttgaggaatgacggcggggtgatgggtattttatagagtgggatttaatcgtgtttagtaatagatttttttaaatttttttttaaaaagagttttttagagttgtcgaaattttcgcggggtgaaagttaaatttttggagtcgttgtgtagtcgggtagaggatacggcggcgcgagtcg

SEQ ID NO: 11149 - DNA, 675 bp, Artificial Sequence
  Description of Artificial Sequence: Synthetic polynucleotide
tcgtttttaaacgtacgattatttttttagttttttagtattaaatttagcggttttattcggttacgtttttacgttaggttatgatttttatatggtttattgcgtaagtttatatttagttttaggaagcgagttttacgtcgttttagttttgtatttatagtcgttaagcggtttcggaagtcgaatgtcggataggttaaagatagcgtcgttgtttcggtattgtcgttagagggcgcggagtcgtcgtgttggtttgtattttttttgttacgttagtcgaacggttacggtaatggaggattttgtcgtatgcgacgataggatgattgttttttttgaagttttattaaatacggagaggtttttttgtttttgggagacgcggtgatgtgacgtagcggttgtagcgaaggttttttgtaaaagatggtcgttgcggagttgttaggtgttttttggtaggcggcggtcgtattataagatggcggttcgttttagggttttatacgcggggttgcggaggcggcggtttcgagggttttcgttttttgttggttttgttttcgcgtgcggggttgcgatttgtttttgtgtgcgggtggaagtgcgggtcgttttggggtcgagttgtaatttcgcgatattttattggagtgcgatgagacg

SEQ ID NO: 11150 - DNA, 580 bp, Artificial Sequence
  Description of Artificial Sequence: Synthetic polynucleotide
gcggtggtcgaggacgttttttttggcgttcgggggtatcggatcgcggttcgtcgggatggaggtaggtaggtagcgtttcgggagggttttagggagcggttcggagttgttcggcggggcgtttagggcgtagcgggtagcgtttatcgagggcgcgtaggtatttttcgaaattttcgttgattaatattttttagtatttagtgaagtcgattggtatttcggggagtgattggagttagttggttataagcgggcgggacggttggagattgtcgggatagcggttgtcggtgttacgcgggtggtgggcggttcggaaatgagcgtttttcggggatagggggttttgcggggcggcgatagttggatttttagcgcgtataaagtttgcgggaggatttattgtagcggtcgttttttttcgtttagcgagggcgggcgtaggggcgggggatgtcgaagggttaggtttgtttaggtcgcgttattttcgttttagacgtttagttcgttttttttataaaggaagaggagatcggagacgggacgtttgttttgttggtcgaatttttcg

SEQ ID NO: 11151 - DNA, 858 bp, Artificial Sequence
  Description of Artificial Sequence: Synthetic polynucleotide
tcgggtacgttgagtttatcgagaattttaaggagttaacgagggcgggtgtttttatatttttttagggattagcgtcgttcgatcgtaattttggggaagatttcggcggttttggagaggagggataggtttttattatttatttggttagtttcgcggaagggttggtggatgaatgaattgttttttcgtcggtcgagtttcgcgggatagcggcggatcgcggggtgtttatttgtggggatgttcgagggttttttcgagttcgtatttagatagggattttaggggtggaggacgagcgttaggagtagtagttgaggttttatcgtgtatttttttatattcggttttcgagggtcgcgcgggtttaggcgtttacggtttcgtagcgtcgcgtttttcgcgagaacgtagagattcgggttcgttttgagtcgtcgattgcgggcgggagtcggcgggtaaggcgcgcggtcggtagtcggagcggcgcgtaacgtagttgagtgaggtcgtcggtggaggtacggagtagtaggcgttcggggcgttgcggaggttttataggtttttcgaggggaggcgacggggcgggtcgcgttttggttattggtcgtcggttgattcgtcgtcgttgcgcgttcggtgcggtcgttttagttcgtttttttgggttttacgtttggattgtttgtttagcgcggacgttatttaaggagttgtttgcggttacgtgtggaggtttacgtagcgtttttggttggaacggggaagtttgtatttagttttgggagtgggtttgggagagggaggaggagtcgtcgggagtttggcgggagggcggtgttttcg

SEQ ID NO: 11152 - DNA, 5715 bp, Artificial Sequence
  Description of Artificial Sequence: Synthetic polynucleotide
tcgggattcggtttttcgtattcgtcgtcggtgttgtcgacgtttatagcgttgatgagattttcgaggtttcgggttcggttttaggagtttttgtttttcggttgaggaagcggcggcggcggcggttgcggttggggtggtagttcgggttttttttttacgtcgatggcgatgtagttgagattattttggaagtcggtagaggtttttttgcgtatgggcgatttatcgtttttaggataatcgattaagttttcgggttgattcggggtttacggtcggttttgcggtgttaaagggggcgtcggttgtaattgtcgtggggaggtgggcggttcgtcgttttttttagggtcgatatttacgtcgttttcgttgttttttttgagagagatattttttacggaggtcgagttgtggcgtttggggttgtgggcgaaggacggggatacgggggtgatcgtcgtggtggaggagaaggtttcggaattgtggcggcggcggtttttttgcgggtttgcgcggatgattttggcgtcgcggtgggggttcgggggttggttggtttgtaggaaggtttcgattttcgatatttgttttatgaggtttagtttttttacgttcgacgtcgggttggttacgcgggtagtttttggtttcgggggggtcgcgataggttgcggcggggtggcggttatattaaaagttatttcggtgtagttattattgttttcggtgttcgaggataacgatgaggcggcgttcgggttttgggcggtggtaacggtcgaggcggggggtaggcggtatagttttttcggggtcggcggcggtggcggcggttgtagagacgacgacggggacgcggacggacgcgggggtaacggcggatacggggaggaggtttcgggggataggaggtcgtttaaggagtttacggggtggtcgttcggggcgttcggtttaggagatttgggggagttgaagtcgaggtttatgtagtcggagagcggagatcgttgtcggttgtcgttgttggtgttcggggtgtttgagtttagcgacgaggtcgggttgttggcggataagagcgaggaggacgaggtcgtcgacgttagtaggggaggcgcgggcggcgataggcgggtttcgggttcgttaaagtcgatgttgatgtattcgtcggggtttttgggtttcggtggtagtgggtattcgtgtatgttgggtaggttgggtagtttttttagggataggcgcgtgggttttatcgttcggtcgcgttggtttaagaagtttttcgggcggtcgtcgttaggtcgtacgggcgaaggtattatagggtgagggggttgcgtggggtcggtttcgaaggcgttggtcgtttggttgggttttggcgtggtttgaggttttagacgttttttttttaggatgcgttttacgggggagtttatgagtacgtattggtcgttgttttcgttataggtgtagggggttttgtaggagcggggtaaggagttgtagtagtagtcgggaacgtttttgagcggtttttcgtcggggtgtagggttgcggagaagaagtcgggcggggtgttcgtggtgatcgcgtcgttgggggatacgttgaggtagttttcgttgggtagtagtttgttatttgtatgttttatggatagtttggaatcgtattatatgcgtatgtatttattgttttcgggggagttttcggcgggcgagttggttttgtagtcgttttcgttcgtcgggaatgttttgttcgtcgtagaggtgggtgttggtttcgtaggtttcgtagaaggtacggcggcggcggcggcggcggcggttttgggttgtaagatttgtttgggggcggatacgttggcggggtttatgggtatgtagtcgtcgtttttgtagttgtcgtttttattgttcgcgagggtcgcgtcgggcgttatgggtatgtagtcgtcgtttgtttttaggttgttgttggagtttttgtgggagtcgatttcgatgttttcgtagttttttgggtaggggtggtaggttattttgggagaggacgcggggtaggacgggtagaggcggttcgcgttgttcgagaaggtggttcgtattagggtgtatttatttagcgaggtagaggagggttggggtatcggtcgttgtcgggttggcgtggttagggagtaggtttttttgcgtagttttcggtttaggttttgggtcgcgtttttcgagattcggcggtaggagcggttatagtggtttaggggtttgtttatggttatgtattcgtagaatttatcgtcgtcgtcgtcgtttcgggtcgggggcgttttcgcgatggattcgggcgtgttgtttcggtggttgtagaaggcgcgtaggtcgtttgggttggagtcgtattcgtttagggatatgaagtcggggtcgttgggggagttcgaggcggaggcgttgtcgttggagggtcgttggtcggggtcgtggtgtagcggatgcggtagaggcgggtgcgggtcgggcggcggcgggtaggagttcgagtcgtggtcgttgttggacgatagggagtcggggttggtggcggcgggcggcgagtgcgttacgggtatggatatggagcggttgtgttgtagcgcgttttttgtcggtagtagcgttattttgttttcgcggtcgtcgtagtcgtcgtttagggtgtgcgagcggtttaggggcgcgcgtatcggttcggggtttagggggtttttagttatcgatatcggtttggcgttcgcggtcgtcgttttcgtcgtcgcgtcgtcgtcgttttcgttggcggtgcgtattcggtacgagttgtatttggtcgtcggcggggtggcggttaggttgtcggtgcgcgagcggcgtattaggttcgtttggttggggggtaggttgattaggtggtggtggcggcgcgcgtcggggacgttgatggggtgcgtggtcgacgatttcgacgattggtttttattgcgcggtcggaattcgaagagttttttgagcgtttttatggtttttaggatggtttcgtggatgttttgcgttattatcgagtcgttcgtttgtatttatagttcgtcggggtttgtgacggtcgagcggtttatttcgatgaagaagaagttgttcgagtggtcgtagcggcggatgtttatgagttgtagcgttatcgacggttgttcgtagttgagttttacgaagtcgatggtgcgcgtagataggtatagacggtatattttcgttaggtttttgttttggtttagatttttgggttttaggtttatttgttatattttacggtaggcggtcgtggcgggagttattagttcgtagttgttttcggtttcggcggcgtcggtagagtcgtttagggcgtcgggtagggaggcgttgtaggacgcggcgggcgcggcggcggggggcgcgttttcggcggtcgcgcggttttcgttgattaggtcggtgagcgcgcggtattagtttttttgtttttgttcgttttcggcggttacggcgaagtattcgtttttggtgtagagggcgattaggtatttgtgtttggcgtcggcgcgtttgttgatgtttaggtagtagtcgagagcgattattcgtttcggcgcgtttgttttgtttcgttattttttttcgttttcgtagtattcgagtcgcggcggttgcggcgtcgatttttcgttcgtcgtcgtttcgtcgtcgttcgcgtcgggttcgcgtagtacgaagaagcgtttgtggttatgtttttgtttgcgtaggtagtcgtatttgcgtacgttgtggttgttgttgttgttgttgttgttgaggttggggtcgttttcgttcgtcggttcgggcggttcgtgtcgcggcgggttcgttatcgcgggcgttttaggtcgcgcggttcgggttcggcgtttaggggttggggcgaggggcggagggggcgcgggcgggggcggtttttttttatttttgcgttcggtcgttcgttcgattacgcgtttttcgggtttaggcggtggggaaggttcggggaggttcgcgggggttagtatcgttcggcggcgtcgcgtttttcgcgttttggggtttttgaggatgttcggcgcgggcggtggtcgttttttttttcggttgtttgcggtcgttgttttttcgggttttcgggcggcgtcgggggacgcgttcgttgggtcgggagtcggggttttcgagtcgcggggtcgagtttaaggcgcgcgcggtcgtatcggggttgttgtcgtcgcgtcgcgtttcgggaagtcggggtgcgttcgggcgttcggggttcgcgtcgtcgtcggggttgttgttgttgttggtgttgttgttgttgttgttaacggcgattcgggttcgtcgcggttttcgtcgtatagtgagtaatatatcgcgtatcgagtgattgaattaagaagagtaaaataatatgtgattcggcgttacgtaggtatatatagcgcggtcgtttcgtttcgttgtttcgtattggcgtcgcgtttttcgacggacggcgcgttcggttaatcggcgcggcgttcgcgggggcgggtcgcgcgttttcgtttcgttttttttttttttcgggtcgcgtttttcgtcgttttttttttttttcgcgaaggtttcggttcggtcgggcggggtggggcggtttcggttttattaattagcggtttgttgtggatgtcggcggaggagatgttatttagggcgggaaaaggggcgcggaagaggggcggggcgggttacggcgcgtagggtttttttttttcgtttcggatttaattaattgggtttgagtttttgtcggggagggggcgtcgggcggggtcgcggttgggcggggcgggggatcgggatcggcggcgggggttgcggttttgtagtggaagtatgggcggcgagtcgggtcgtgttttcggggcgcggggtttttattttgggcgagggcggtcgttttcgcgttcggggtgggcgcgttttattttcgtttttcgtttttcgttttcgtttttcggtcgtattttcgttttttcgtagtcgcgaaacgcggggaggttttagggttcgcggtcgcgggttcgcgagtatcgcgttttagatcgagagcggcgcgcgttttttcgtggaggatagaggggcgcggagggggcgtttgtgttttattcgttcgcgggcgttttacggggcgttttttgcgttatttatttgttagtttgtcgggaagttgaaatcgcgtttgggaggtaataggagaaagagatcggggacggtaggcggagaaagtgcggtttttatagcgtcggggagagggcggattcgcgagttagcggtttttgagtcgggagatcgcgcgggcgtttttttagttttcgtaggagcgtcgtttttttttcgtaggggcgttttttttttttatcgttgtaggagtattttttttttttttcggaagcgtttttttattatatcgttttaagagtttttttttttttttataggggcgtttttttttttttcgaggtaggagcgttttttttttttttataggagcgttttttttattttaggagcgttttgcgtttagtagacgggtaggtgggcgggcgtttattatttgtgtgcgcggtgcgggcg

SEQ ID NO: 11153 - DNA, 858 bp, Artificial Sequence; identical to SEQ ID NO: 11151
  Description of Artificial Sequence: Synthetic polynucleotide

SEQ ID NO: 11154 - DNA, 247 bp, Artificial Sequence
  Description of Artificial Sequence: Synthetic polynucleotide
tcggaattttcggggaggattaacgtcggcgtatcgtgcggtcggggcggggcgtcgtttaaatttaggttttgtgatagcgattgtggcggtttggaaagcgtgggtttcggttattgggtacgagcggttacgtgatagcgggtttttttaggttagcgttggtggttgagtgatgtaattacgtggggtttgaagttttcgtgggtgtaggttttttcgttatgttgacgataggtagtgttcg

SEQ ID NO: 11155 - DNA, 224 bp, Artificial Sequence
  Description of Artificial Sequence: Synthetic polynucleotide
acgttcgtttttttttcgggtagttttttttatttaggcgggatttgggttttcgttggatttagggtcgttttttcgtaggcggggtcggttcggcgcgtattttgtttcggatgttttggcgtacggtttcgcgtttcgtttttattttggcgtatttggttttgcgtttttttttcgtttggcgtagcgttttttgtcgtttttttttttttttggcggcg

SEQ ID NO: 11156 - DNA, 1174 bp, Artificial Sequence
  Description of Artificial Sequence: Synthetic polynucleotide
gcggcgaattaaagagtagggaattataaaagacggtcggcggcgagtaggttggggtgacggggatttcgtggataacgggtttgaggacgtttagggttttagttttttttaggcgtttttcgtcggggtaacgtagagtagttgtcgtttttttcgcgttttagtagatggtggtgttagttcggtttcgtgttcggtcgtcgttgcgttcgcgtttttttttttcgtagatggtttaattagggttttcgttcgttttttcgcggttttcgtttcgcgcgtttgggcgagcgttgcgaacgtggagttaggtagttaagtgttattgcgtatagtaggtagtttggtaattgagagtataatatcgagtagatggtgttcgtacggcgtgatggatattatatacgatagtttgagataatttaggaattttttggtgattcgaggttttttttgtataaaatgagttttttttttattgtcgtgtatttttggggttatttgtttttttttttcgattgatattgaattggttttttattatcgattttttttttagtcggaggggaggaagaatttaagtgggggagggcgcgggaaggggacgtggagggaaacggaagggttgggagtggggtaggggggtagtggcgattttcggggggggagggtggcggatattagattttagggtcgatagttcgggagggatcgggttttaggattttagttgtataaagtcggttcggggagggggcgataaggagcgagtttcgggtcggttcggtatcgttgtttcggtttagagtttttgtaatcgtttggtttacgaataatttaaatgaaatttagggttttattgaaaaagttttttggggtttaatttagtttttcgattttagtttatatgtttataagtttttaggggatttcggttaggaagttaggagtggggttcgtgcgttttcggtaggatttagattgtttttcggcgtaggcggttttaataaagaagtttacgaggcggtttcgggcgcgggtaggggcggtgcggcggcgttcgggagattcgcgaggggttttggaggttttcggttcgcgcgcgtcgttcgggagttcgcgaggttgcggtgtgttttagcgggcgtattttttaggtttcgttatatcg

SEQ ID NO: 11157 - DNA, 8657 bp, Artificial Sequence
  Description of Artificial Sequence: Synthetic polynucleotide
tcggattttttttcgggtttttcgggcgtttcgttttttcggggttggtttttttttttttttcgggcgtcgtcggtcgcgggtcgtttattttttttgggttcgtagtcgtcgttcggggatcggtagtgggattcgagcgggtgcgcgttcgttttgttcgcgtcgttggtcgtttttggcgcggtgtgtagggtttcgtcgggggtcgcggtcgtagagttgtatcgtaggagattttggttttgtagcgtcgcgtttaagttttcgtagtttgtgtagttgtcgtagaagggcgacgtgtagtagagggggcggtttagtagcggcgaggtagggtagggcgagttttttggcggtgtttcggttgaggtcggcgcggcggtcgcgggtagtttcggtggttcgtagttcgggtttaggttcggttgtttgaggttcgacgtggcgatttcggttagcgattatagtttgggtttgttggcggggggcggcgcgttcggagacgttcggttgttttggggcgttttgcggttatcgcggggcgcggtttcgggcggggggtttagtagcggcgtttttaagtcggtaagcggcgacgaggttacgggtttgggcggcgttaggtttcgttcgtttttttcgtcgtcgttttcgtcgttttttaggtcgttatatttgtttttgtatttcgagttcgattcgtatagggggttttcggcgcggtacggaagttttttttcgttcgattcggtcgagtacgagtgattcgtgagcgagtttacgtgtaggttgatttttgtgggggcgcgggtacggtgggtggtacgaggggatagcgtaggtatttggagtttttttcgttttttgttttgcggtattgggttttttttacgggattttttatttcgtttttattcggttacgtgataggcggagtttgattttttcgggaagggttcgaggaatcgttcgtttaaatttcggcgattttagggtaatgtggtgcggttggggtttcggttcggatttggggtgttcggcgggtaacgtttttttcgttttagttttgcgtttcgtttgggaagaaagcgtttcgagattttgcgtcggtcgttgttcgtttattttcgttttttgtcgaggttttcgtgtttttttgcgttttgtcgggattttcgtttttgtttttggtagcgtcgttttcgttttcgtttttattttcgtttttgtttttcggggtttaggttattttgtttttttttttgaggcgtcggcgcgcgttggcgaattaggtggagatttgggtgagggttattttggtgatgatggttagtatgattttttcgtttttggtggggtaggggtttttgcggtgttcgttgagttaggttttgagagtggtcgtggcgtttcgcgtggcgtttttgcggtacgcggggtcgttgagttggtacgggtaggtcgcgttgtcgtacgggtggtagttgatggcgtcggttatgtcggtggtgtgcgcgtcgtagggtgcgttttggaattaataagagtttgtgagtggagtatgcggagatttcgcgggtaattagttagaggatgttattttttcgttcgtttacggttatcgtttttttcgtgagtttggttttggggttgcgtttttcgtcgtaaaagagtaggaaaaacgtagtgtgattcgggattagttgttgattataaaaagtatcggagttttattttcgaatttttgaattattttatttttttaaaatgatttatttttttttaagtgtttcggagtcgttcgtggtaatgtatataaatttttgtacgtgcgcgtatataggtttataggtagttttttgatatttaaatttttgtagatgtttggagtgcggttgtttttttttatttttttttttttttttttatatggttaaaaaaatattttagagtttttaatttattatttattgttttaaagttgggtaaatttaatttgtaatttagaagttagttatcgtttcgaattttttaaatacgtcgtaattagtattttaatttattttttaacgtttaaattcgaggtatttgtagttttcgttaaggttttagcgattcggtcgttgtttagaaatttcgtcgagggtcggtagtcgcgataatttcgtaatggttttaatcgttcgtaacgtgtttcgtcgcggttcgggtttggtttagtttagtaatttcgagattcgcgagtcgtttttaggtcgtcggagtaggagttgcgttcgggttacggaggatttaggcggtttttagcgggttacgcgttcgtaagtacgatatttgaaagtatggttcgttggatagagtaaggtcgaaatttgggcgtttcgggtcggatttcggagtcgtagttgaatgttcggtttttgggtttaattcggtgatttttatcgttttgagtttcgcgagtgaatgcgaatcgttcggtcgtcggtttagaggtcgtagtgacgcggattttcgcgttttacgttaatgtaggcgagtatatagttcgtttcgaacgtttttttaggttgcggtgcggaaattagggataaacggcgttagatttcggtttcggcggagacgtattttttaggtttttagagaaaattagtcggcgagtcgaggggacgcgcggggggcgcgcgggtttcggtcgggtttagggacgttttcgtttgtcgcgttgttttttttattcggggttcggtttagtttgcggggcggttaatcgagtcggcgatttttgagtcgttagtcgcgttatattttcggcggttttcgttcgtcgaattcgagtttcgtttcgtttgagtttcgtttgggtttcggcgtttaggagtttcgcgtttcgttcgcgttcggttattatgtaggacgggaagtcggcggcggcggcggcggcgtcggtcgagtattgtagcgggttttcgaagtcggtggtcgtttgcgtcgtgaaggtcgtcgagttcgggtaggggttgaacgtcgagttcgacgtcgagcgcgttagtttttcgttgcgcggagtcgttaaagtcgacgcgtcgtaggtcgggtacgagtagagcgttagcgagtcgggcgtttggtataggtagttttgcgggtaggatatggtgggcgcggggcgcggggttcgcgttacgtcgagtagcgggtagggcgcgcggcgttttttatttacgttcggtcggggcgcggcgcggcggcgggtattcggacggtcggcggaggtaggtcggttcgggtattagtttgggcggttcgcgggtcggggcggcggcggggtggcggtggcggcggtagtagcgcggagtcggtgggcgtagtcgcgcgttaggtcggcggtcggggtttgggggagtttggagtcgggagtgaggagttgaggaaggagcgttcgagttttcgagggatattggaacgcgtagttgtttattacgcgtttatttgtatattcgggggttcgttttttttttgtttcgttcgttgtagttttcgggtcgcggttgggggaggggtagagagacgggagggaggcgggggagggcggaggcgacggaggcgggcggcgggagggatcggtaggtttttgtggcgtagtcgtttttttagtagtttcggttttagttcgcggttcgcggatttgtagtttagttcggtcgcgttgcgtgtttcggcgcgtattttttttatttttatttattcggagttacgttttttgttcggtttcggtcggtttttatcgttttcggttatcgttttcgtttttgttcggttttcgttttttttagttattatttcgtttttatttttttttttatttttatggattaggtagaggtcgttcgcggttaggttaggtcgggtttaattaggggatttatagtttgtttcgttgtgtatttcgaggaggttcggtttttgtgtttaattcggaagtcgtagggaagtggggaggttaggatggtggcgttcgcggttcgggttttttttcgggtagtgcgcgcggtttttatttttacggtttcggatttgttttgttttttggttcgaggtttttcgcgtggtttcgcgtttggtcgtttatttttcgcggtttatttcgtttagtatggatttggattcggggcgttttggttgcgaattgttaggagggttttgaggtgagttttttgtttttaaattcgtagcgtaattttcggggttttgaacgttacgattttttattgttgggaatgacgttagggttttagttaagaagacgtcgttttttaaagagttttattttattttgtttttttaagttgattttttttttagatttgtgttgttaaaatattggggggatgattgttatttgataaatcgtttttggtaggatttgaagttttttagttacgtcgagaacgggtaggagtttaggttggcgtcgtcggtgtagtgggtattataggtagtttaggtgacgcgcggttggagtaggggggcggttgttttgcggggtttagaagcgaggcggttggcgagggtttttaggattttagttttttagaattttttttttattacgtttttttaatttttttttattcggggatggtcgaagagggcgtttggttgtttatttcgaagggttatttatggggggcgtttagggggatggaagagtgttaggtttgtgttggtttattgggagtatttatttagtaggtgtttttattttcggaagtcgtttcgggtgggtgcggtggagaagagagagcgtagtggtttggggcgggttttagtttaggtttgtagtcgatttttgtatttttgttggttttgtagtttgcggagtagttttagtgattttaggacgtagggtatgttgcggtttttttgtggtgcggttgtagcggcgcggagggagcggagttcgggttgttagtttggtttagggcgtaagagaaatatttacggtattaggttgtttttttttaggtgtaagggaattagttgtaaattgtagtgttgtgtttgaggatggttttttttgagtcggtaggttttcggtaggcgcggtttaggtacgttatttttttcgttaggagttttcgagtcgagttattcgttttttattagttattttatttattttttcgtttatattgtttttttattattttttttataaattatatttttattttgtatatattttttttaggttattttaatatacgtatacgtatatatatttacgattatttttttttttatttatagatatttcgtttttataggttgggttttttgtaacgatttagcggggggttttaattttgttgcgattttatatgggatattttaatttagtttaggatagatatttttaattaattattatagagttgaaaaatagagagagagagaaagtagtcgggttgggtaagtcgtcgatagtttgcgatatttttgcgttttttgggagggaatttttttaagaagaggggtaaatgagaggtttatacgttggatggtaaatataaatattgttagattagatggtaatttttagggtttttttacgattagattagtttaaatgaaaaaaaaatcgggtgtaatttttattattagggagtattggtttggagtatttttatttttaaagagcggttttcgttgtggttttattagtatttggggtttatttttttttttttttttttgatttattttttttttttcgtcggatttttgttaggggtagaagagaaaatagttagttattatataaatatttttagtttggagttggagtgtttgttttggatatagtcgattttgatattaattaaatatataattagatacgtgtagtggcggggagggtttttttatttagggtgtatttttagaaacgtcgtttgtttttttttttttttagtttagtgttgggagtttgaagatggttttttttcgttttgtgtgtattttttttttagtaattatatttttttattgaaatttatatgttttatatcgttgttgtttgttattaataaaaatcgtttattttgtattattaaatagtcgatttttattatatgtcgtttttattggtagtgattgtagtaaattaaaatgtttacgtagggatattaaaaatttaatattcgttattgttattgaaatatataaattacgttttgttttaaagttttttgatattaaagaaaaaaattatattttttttttttaagttaaagttggtttggttttttttttaaaaaaaaaaaaaattaattatgagaaaatatgttgttagcgtggagttttggcgcggcggtttcggcgaggttgtttgagagggtggcgggtttagtttagatttcgtttcggggttacgagggttgtaaggtcgcggttttcgaagaggagggtttgggatgttttgtttaagggcgaggcggggtgtttaggtttgtggggtcgttggggagagttcggtatttggtttttgaggttttttagttgtcgttcgagtaggagggagggaatgagtaggtacgtagggaaaatttagtaattgttttgtaaacgcgatttttggttataataatttaggcgatgggggtagttttaggtttttggtgggttttgtttttttttttaggtgtgttttaggaggtggggaaaaaattaatattgtttttatttttttttattgtttttgtaatagttaaagaatttagaacgagtttacgtggatacgtaagttttagcgagcggggattttttgcgaggtcgagcgcgaggaatagtcggtttcggaggttcgggttcggggttttttcggggacgcggtcgattgagaaggtcggggcgttcgtcgggcgcggcgtcgtttttcgtgtcgcggggacggaaggaggcgacgtaggttaggagtcgtgcgcgcgggcggcgagggggcgttgtggttcgtgtttgtcggttcgagtttcggtaacggtgggcgcgatttattttttttttcggcggtttaattcggggaagaagaaaaaacggtatcgaggtattttaataaaatttaagcgatttttgatttttttttattgtggttttttatgagttttcggtgtttggcggggaaatagttatcgttcgggggtgtggtaaatttttttggtaattaagatgaaatagacgtttttatgtgggttttttttaatgaagtaatattggaaatgtaagtagttttagtgtattaaattatatcgttatcgtattcgcggttatcggttttttcgttttagggtttttcgcgtttgtcgagggagagagcgaggtaggaatagggggtcggggatatgagaagtttggttaagaaattttttttttttttgaaaataaaagcgttgttataaatggaataaaatttaagttaatatggaatttatattttttttaaacgtcgtttttaggtttagtattttgtgagtaggttggattggattttacgtttaatcggtatttttaggtttttaaagacgttttcgaggtttaaatgtttttttggaaaatacgtgtagaggagtattcgtggaagattgaaaggttttcgtagttttagttttggtaggatgtgtaaggtttttcgaggtttttaaatgggttttcgaggtttgggagattttcgagtagttacgcgggcgttattttagggacgcggggcggcggttattgtgggtcgggagggttttcgtacgggttgttttgagcgtttggattcgggattttgcgcgcgtttttttttttttttttcgttttttttttttttatttataatttatattttagggatttcgtatttagttaattagtttttgtttatttaattgttttgtttttagtttcggatttttgggaggtttttttatggttaatttgtttttttcggtattttttagcgttttgtaaaatttgttttttttttatagatgtttcgttttcgacgtgttttttgaagtttttttttcgtttagggtgtttataattttgaattttttagtatttcgtcgatttcgtttttattttttttttttttttaatttcgcgttggtttcgttttttttttttttttttttttttttacgcgtttcgttttttttttttaggtcgtattttttttcgttcgggtcgggagtttttcgtggttaggcgttcgcgcggtttaagatcgaggttcgttacgttgggtcgttcgtgggcggtttttattcggtatatcgtggaaacggcgcgtttcgttagttgcggttttagtttgggagggagcgtagcgcggggagtttgtagcgtttggagagtgaggaaaagggatattttttggaaatggatagagtcgagttttttaaagggatcgtagttgaaagagattttttttaaaattagtaacgatttggtagttttagttttttaataggagatggttcgaagatgaaatgtttgaaatttcgtcgtcgttttatttttgtatatacgcgtacggtaggtttagattcgtatagagacgtagatacgcgcgcgttcgcgtttttcggagaggtcggcgcgtttcg

SEQ ID NO: 11158 - DNA, 1059 bp, Artificial Sequence
  Description of Artificial Sequence: Synthetic polynucleotide
tcggtttgttatcgttttttagggaacgagatattgttgagttggaagatttcgcgggttataggtatagtttttttgttgttggcggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgttggggtttcgggcggtacggggcgcgggtgggtcggttggtgagcgttatcgtgtttgttttcggtttgttttgggttttttattacgtagttaattttttgtaggcggtcgtagcgttggttttatcggaaggggttttggcgaagttgggcggagtcggttaggcggcgcgagcgggaattacggttttggttttttttagttttagcgttaattcggtgttttacgtttttatcgttggagatttgttgtttcgggtaggttttcgtttttttacgcggtttttcgaaggttttggggaggttcgagggggcggtcgttttagggaagggattatggagtttcgaattattttttagttgaaagtggtggggtagggtcgcggtaatggagattcggggggtgggatggagaaggacggttcg

SEQ ID NO: 11159 - DNA, 1663 bp, Artificial Sequence
  Description of Artificial Sequence: Synthetic polynucleotide
tcgtttttcggttttcgtttttcgtttttcgggtggtgaacgtttgaagagggaggcgtggtttcgcgtattttgttttcggtcgcgttatcggtatttatttggttgttgtcgtgtttttcgttcgttttcggggttcgagatttcgcgggatttcgcgtcggttttgcgggaggaggcggcggttttagtagttgttttaggtaggcggtgttcggtagagaggagtttttttggtggtataagtgcgtttcggggttttgacgtcgtgtatttttatttcgggcgcggttttttttcgggggaggttggggtgaggaggatagggaggatgaggcggaggaagaggaaggagttgagtcgggggagcgttcgttaggaggcgtttttttcgttgttttcgaggtcgtcgcgggtttttttacggcggggagtaaatgttcgcggattcggcggcgtagcgtggatttttgttcggttttgtcggcgtcgtcgggttttaggggtttcggcgacgagtagtataggttgggttgcgaggaggagaagattcggtttagtatttgttttcgttttttgaagtcgttttatttgttgtttgtattattttttttggtcggtgtattttttgtgtttatcgggggtggcggggagggcgacggggtgttcgtagtgcggcgttttggatttttagcgcgttcgttttcgtcgtttttgtttttgtttatttttagttgtaggtttttttagagtcgggtttggaaggaggaggacgtcgtcggcggttttggttcgttcgtcgcggtagttcggggttttattttttattttttgttttttttttttttttttttttttttttttttttttgtttttttttttttttcggttgtattttttttcgggtttttgcggcgttggcggtggcggcggcggcggcggcgggcgtagtagtagaaatcgggagtgtttagcgattttaggttagttcgggggaaagaagcggtcgtcgtcgtcgaggttttttggtttcgggatttcggcgttgtttttttttttcgtatttgttggggtgggttggagtcgtaatcgaatttcggtcgcggcgtttgtaaagtttttttttcgaagtttcgcggttttagtttattggcgttttttaggtcgcgttttggtttttttttttttttgatcgagttcgggaagttgtacgtatcggggcgtgcgcgtttagttgcgttagggatcgtattcggcgttttttgggtagtatttgttagcggcgggggcggttgtttttaaattgggcgcgtacgcggtttatataataaggcgcgtttggttggagatttcggggattagtagtttttttggggcgtttcgggattattttttagtttttaggtgggagggtcggtaggagtcgggtggagttaggtagggttcgaagttagtttgttttttaggattcggttatagttgtttaggtagttcgttgtgcgttggtcgttggtcgcgttggcgatcgtttgggtcggatgaagcgagttggagtggaaattatgtgttttcgatgggtttcgtgggggcgtcgatcgtttatattgagcgatgaattcgacggagttttaaagttgaagacgtttgttttcgtttcgttgcg

SEQ ID NO: 11160 - DNA, 2065 bp, Artificial Sequence
  Description of Artificial Sequence: Synthetic polynucleotide
gcggatcgcggcgtttttagggaatatatttatttagtaatcgagattagagttggagcgttgcgtttttaattttggggcgggcggggggcggcgggaatttttgtttcggttttttttgtatcgcgggggtagttgttatttgtaaggcgagcgcggcgcgggggatggaagtaggcgtttattggatagaatataaaggtagaaatttatttcgaaggtcggggttcggcggggcgttgggggtgggcgtttttcgcggttttcggcgtttttcgtttcgagacgtttcggtttagcggtattggcgcgatcgaggtttagtttcggggatacgttcggttggtcgcggggaaggtattaggtgagcgcggtcgcgtttttcggaatttcgttttcgcgcgtttcgcggcgacgcggcgtttattcgtttcgggagttaggaatttagggttttattatggcgttggtcgtcgtcgtcgtcgttgcggttgtcggggtgagttaggcggcggtgttgggttttttgtaggagtacggcgggaaggtgcgtaatttcgagttgttgagtcgttttaagtcgttgttcgatgtcggcgattcgcggggtcgcgtcgttcgtagggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcggagcgtttttgtttcgggagtttcgtttttggttcgggtgtcgcggttagtggagtcgttaggggatttgggtttgttaatagagttataggatatttcgggggggtcggttttcgagttcgtttagtcgttcggggagcggttcgtcgatttatcgtttttagtttttgagttagtttaggttatcgagagatttttcgtagacgcggttttatcgtttagggttttttttgaggcggtatcgttttgttttgattcgttagacgcggagttcgggttcggggtagcgaaagggtcgtcgtagtagaagttttgtatgttgtcggtgcgttgcgtttcggttttcgttacgtttcgttttcgggcggaggagttcggtttgcgtcggtagttgtcggaggagtcgagttcgcggagtttttttttgttgttgaggcggttttcggtggaagagttcggtttgggtttcggtttgggttcgggtcgtttttcgtatttgaggcgtttgtcgcgcgtcggttcgcgtttgttgagttttgacgtcgaggagttgttcgtcgcgtcgtcgtcgttcgcggtgtttttggagtcgttcgagtacgagtggttcgtgcggattgtcgggggtcgttggatttattagttgtacgggttgttgttgcgcgatcgcggtttggcggttaagcgcgattttatgtttggttttacggttttgtattgggtcgttaagagcggcgacggcgagatggcgttgtagttggtggaggtcgcgcggcgtagtggcgtattagtcgacgtgaacgtacgtttttacggcggttatacgtcgttgtatttggttgtattgtacggttacgaggacgttgtcgtgttgttggtggtgcgtttgggtgtttaggtgtacgtgcgtgattatagcgggcgtcgcgtttattagtatttgcggttcggtttttcgtacgcgttgcgtcgtttttttggcgatttaggtttgcgaggtattacggagttagatgcgatcggtggtggaagtggtagttttgttgttaggcgtttcgtataggtggtcgttattatttttagttttattattagtgtatttttgggcgttttggttgacgattttatgttttaggatttggttcgaggtttgaagaagtcgagtttttttagtaagtttttgagcgtttcgtttatggttttacgtaaaaagataaagattcgcggtggtttgttagtttttttagaaatttttcgtcgatttatttcg

SEQ ID NO: 11161 - DNA, 3487 bp, Artificial Sequence
  Description of Artificial Sequence: Synthetic polynucleotide
tcgagagaaggtgagttcggcgggcgtagcgggttgggtgggtgtggttcgcggtttcgggaatagatttaaggtttcgttatcgtcggttagtagttcgatagttcgttcgtttggcgagcgtaggttttttttttagaaattgcgaggattcgagcgtattgtttgtgtattataaggttaagtcgggaagtggagtcggaggaggaggggcgaggaggcgaagggtggggagaggggcgtttcgttttttcgttatgtgttagtttttggaagttatttttcggtttttaatttttcggggtaatgggaaggaagagtaaggaggaaggggtcgtttcggggtaaaattttgttggggttaggatgtgtaattatttatttattcgtttattattgttttttttatttttcggaaatgcggggtagcgttaggcgttaggaggtattcgggaggggggagggggcgacgagtttaatggggattttttttacggatcgtttttttttttttgaggtcgtttataattttaagttttttcgttcggaatgttagttttttatttggagtgggtgcggggaggagggtcgcgttttttttttaagattcgcgttcgtttttttattttttttttgttagtattttttgtttatttttggtgttgtaaaacgttacgtaatttattcgattcgtattttaaaattagcgatttagaagtagggtttagggcgagggttttttagcgttggagtttcggggggcggggtgtttagtgtaaatttcgtttttttcgcgagtgtcgtttttaggttgttatttgtaaagaaacgtttttttgacgtagggagaaatggtaaattttaagtacgttattaatatggcgttaaaagatttttttaagtataagttcgtttttttttttttttaaggttgcggggggcgtcgttcgggtttggggcgcgtagggggcggggtgtgagtagaaagtgtgagtgaaagagtggaggggcggggtatgtgtgtgagtgtgtgaagtgtgagtagatttgatgggatttgtacgggcgtagtcgtcgttcgggttcggttttggggatagggcgggttaggggcgttttagagtttatggggagttcgggtttagggtgttagtaggcgtggtggtggggttgcgagggagggtattttttttttacggggttcgtaacgttatttggatttttcgtcggagttaaataattgggcggggggttgggggggcggcgacgggggtgtcgggagcggagattcgagtgaataagaaaaaagtggttattttttttttttcgttttttttgttcgtttttattttatttttattttaatatattttttttttttaaagagattataaggaagttttggtttaaaaagaaatagaaatatatatagggggttggtgaatggtgtcgatcgcggttatcgtagttggaggttattttttggggggggtgagtagcgtttatggagttattttgcgtttatttttagcggtatcggtttaggttttgcgggtcgatcgttttcggcggggggcgtggggtttgggacgtcgcgggttcggtcgtttttttcgtcgcgatttcggatggatgcgcgtttttcgttttttcgcgtcggttttaggagttttcggtttcgggagtatttttttcgcgtcggtttttgtagcggcgcgtagtcgagggtagcgttcgttaggggggtatcgcggagtaaggtaagatttagttttcggcggatgggttttgcgtatttttacgacgttatttggcgtttttgtaatagatttgttagcgtttttcgttttttcgtttttttttgttcgttcgtttttttttttttttgttggttgtttgttttaggaagttagcgcggagaggggggggatgtatagtataggggagagagattgcgtatgttggttagtcgtgttttaaagagtatagtgcggggaggttgagaggggcgtatgtaataataatttttggaagggtgagtttggcgattttttttattaatgattgcggtaaagcgttttcgggtcggcgagggggcgcgggcgggcgggggcgcgttagggttgtaattttttcgcgggtttcggtcgggcgtaggggttgcggcgggagatgggtacggtggggaggtcgagcggttcgggcgggggtttcgagaatttggagttatttgtttttttgttttttcgagttttattttgttgatacgtagtacgttcgggcgtcgaatcgggttgagtcggtgtatatgatttcgcgttgggtttacgtgtagtcggttcggttttagatatttttcgggggttatcgttttcgttttgtcgttttttttttcggttcggtgtacgcgggcgttgtacgcgggggtagtatgttcggtttttggggttggaggttttgtataaattagatagtttttttggaggggcgggggatattttttttaggtgagtgtggagggtgcggagtttcggcgttaggggtgaggattggggtcgggggtagtttttattttcggggtcgcgcggtagtttagttggggagaggcgttgggagagtggaaatgtatcggcggcggtcggagcggcgggtgcgcgttcgcggggcgacggtagggggcgtggtttttgtttatttttttttaattttgtcggttcgcgtttcgttttagggacggattcgtagtttttagttttttgtttagggttttgtattatgggtggtattaggaagatgtcggtttgtggcggatttcgtttgggacgtatatatttgatttttaaatgagtgatattgtagttttcgtttttatttagcgttgttgtagtttttttgtcggattttcggtttcgtttcgttttcggtagtggtattttttcggttttatttttttttttttttttttttttttttttttatttattcgtttgcgtttgcggagcggcgttcgttcgtttttttttcgtttgggtgtagatttgtggttttttatggttttttttcgtttatttttgggttttgagatatttttttttttcggttaagggacgagaggggttaatttggcgattcgtagttgttttgttagaggatggggttgtttgcgagatagttaggaaggttttattttagtttttagaggtttagttttgttttttattatatatagttattattttattcgtttttggggttcggttgtttttttcggtgttttttaaatttttttttcgatttgggtgttaagtttatttatttttcggcgtcgttttcggtcgaatagttttttgtttttttttcgtttgggtcggagtttttcgtagtttttttcggttttttttttcggtttcggcggtcggaattacgtcggcgcgtttttagtttgcggtttcgcggattgtttttaggggcgggttggaggcgcgcg

SEQ ID NO: 11162 - DNA, 847 bp, Artificial Sequence
  Description of Artificial Sequence: Synthetic polynucleotide
tcgaggggaaaggacggatttggcgtttggggttttttcggtgggatttaggtgggtggttcgcgtggggtggggtaggggtatttataggcgtttagcgttgcgggggatgtttcgaggaatcgcgcggaggtttagttcgtggtagtttacgttggtagcggagtaggtatatttggtggggtaggcgacggttggaggtttatttaggacgttcgttagcgttaaggttagcgttaggcgggcgcgtacggcggcgtcgatttttgtttattcgggggttatggtgtgtagggtttcgtttttggaggaggttgtttttgcggggtaagacgcgtggagttcgaggaggcgcgcggggagcgcgggcggtttggggagcgggcggcggagttagcgcggaggaggggcgagttcggtgtttaggcgtacggggcgcgggcggagcggggcgtttcgggcggcggcggcggtagtaatagtagttttatcggcggggtcggcgttgtttcgttgcgtatcgttgggagtgtttaggtgcggagcgttttttggtttcgttggttcgcgggtcgggttggggatttggggcgagcgtaatggggcgtggcgttcggggaggttcggtttggggttgggttggggagcgcggcggttgcggttggggtacggggcggtcgggtgagttggtcggcgttcgttttttttatttagtgagtacggtagatatcggagacgcggggtttattttttcggttttttttcgattaagaaacgttaatttcgttttttattggttgcgtcgcgcgttatgtcgattaagttgggaattttgttggagcgatcg

SEQ ID NO: 11163 - DNA, 909 bp, Artificial Sequence
  Description of Artificial Sequence: Synthetic polynucleotide
tcgtttagtatagacggggtattttcggtgcggtttgttatcgttttgtttggcgttggcgtttttagagaaggttatgtcgattttttttttatttcgttttagatttttttttttgagttgttttttttatagtttttttaggcgttattgagagtttttcgttttcgatgggtttggggcgtttggattttttcggggttattttgtcgtttttttttagtttttttttttattttttgtcgtcgttttttcgtttttttaggattttgcgtatttaggttggttttatgttttggggtattttagtagtgttttcgggttttcggttattcggtgacggagggagggagaggttggcgagggggcggcgttttaggttttagcgcgattcgttttttagtttttttcgtcggttatagtcgcgcgggacggggtagggatttcgagaatatcggggatttgcgggtcggtggtttcgggtaggttatttttgacgcgggtgcgaggtttttcgcgggcgtgtacggttgggtcggagtcgcgtcgggggtcgggatacgtttggggttagcgttggcgtcgtcgttcgggtggggtgggtcgggttcgggtttagttttttttttacgggcggttcgcgtttcgttttttagtgatttttatattttttgcgtttcgagttggaatttcggtaggttttgtttcgggtcgcgcgcgttttttggggattagggttgtggtttttgtttcgcgtcgtgtttttagatatcgtcgggcgttcgttttttatttttttttttttttttttatttcgcggttgacgagggtcgtttttaagtggttatgtttttcggtatggacgattttttagtgtttttgagggtttagggtttcgttttcgtttcg

SEQ ID NO: 11164 - DNA, 2150 bp, Artificial Sequence
  Description of Artificial Sequence: Synthetic polynucleotide
acgtcgcgtttcgtcgttcgcgggttcgtcgggagattgcgggttcgtttcgcgggtggggcgtttcggtttttttcgttttttggaggttataggttacggcgacggcggtgatcgggagagtaggttgcgaggcgcgttttatcgggttatagataaattatttcggtagcggtcgcgtcggaattttttttaagttattaaattcgtttacgcgcgggagagtgttggggatgttttatgcgttcgcgattttagaagttaggagtgtgttatttttttatatatttattttcggttttgtacgtttttttttacggttcgagtttttgtaaatgtttggttagatcgaggtcgtcgagatgttcgttttagttttttttttcgtgggtatttagggtagttcgtgagcgtcgttcgtcgtcgtttttagcggcgtcgggttttcgaatattcgtcgggtgagcgaagtatagcggggttacggagcgtttcgacgcggggacggggagggtagtgttttttttataaattagttttttgggtgaagtttttggggtttggagattggagtgtagggtgtgtgtgtgtgtgtgtgtgtgtgtgtgttgtattttgattttatggaggatttgtgggagaggaggtgtaaggttttttttttagaagtttggcgtttttaggttttagttacgcgggacgtttttcgataattcgatttttcgttaggagagattcgatttaggtttgcgtcgcgaggtttttagttcgtttttttttgcgattttaaatttgggttttgatttttcgtcggtcgcggtggttcgggttattcggcggcggttgatagttgagcgtaaaggcgtcgcggttaaggttttcgcggagtagttcgggatgcgtacgtcgagggttaaggaggaggtcgttcggtttggagttgggatcgtaggttgggggtcgggatattcgggtttcgtcgggtcgggggtagggtcgcgggtttgatagttgttgcggttcgcgcggacgcgcgttttttgtagttcgttttttttatgtttgatttattattttttgttttttttttttttgttgttttaaaatatttttcgacgttagtaaaatataatgcgtttcggtcgtcgtaaatagtcgggagggagagtatatattcggcgcggcgcggtcgtcggttcggtttttatttttttttcgtttttagaaaatgttataaaagcgggtagggcgcggggagggcggttgcgcgttcggcggtcggggtttttttttcgcgtcgtttttttacgttttttcgttcgtttcgcgcgttcgtttttttcgtaaatttgtttcgttatttcgtttagcggcggggttcggggttcggggttcgggatttatttcgtcggagaattttgcgttttttttcgttttttttttttcgcgttttttcggttcgtagttttttttcggtagtcggcgaggtgggtagttcgtgggttatcgaaagttcgcggaggggacgcgtattatatggtagttcgtttttagtttttcgagtgcgttgggaagggggaggggaaggggcgaggggaggtcggggggaaagcgagagcggggcggcggcgggagtgggtaggcggggtggcgagggcggcggtcgtttacgttagcgttgtgcgatcgtagttcgggcgtgtacggtcgttgttgtcgttgttgttgttgttgttgttgttgaggcggcggcggttcggcgttgtttgtttcgcgtcgcgcggtttgcgtttttttcggaacgtttatatttttaatcgttatattgttgatattcggcgttgacgttattcgttttttatttataataattttacgggagtcgggtagcgtattttttcggtcgttggggcgcggtacgttcggcgattagcgtaagtcgtttcgcgaatggcgtttcgggggttggggcggggggcgggggacgggggcgggcgcgcgcgtttcgttggttcgcgggagggggcgcgttttatgtcgtcgtagtagtagattttttcgttttgtgcggtcgcgcggttcggagagtttttttttttcggttcggttgatcgtttcgttcggtttggttttttcggttacgaaagacg

SEQ ID NO: 11165 - DNA, 506 bp, Artificial Sequence
  Description of Artificial Sequence: Synthetic polynucleotide
gcgttcgttgttttcgagtttcgggtttgagtgttggttggcggagatttatagtgggtgtttcgttttcggacgatgtttttgggtttttagatttagagtttcgggacgaaattgttttaggaagattcggaaggattcgtcggtcgcggtaagggataggcggtttttgagataggaggagttaggaaatgcggggtttggtggggtgaggagtacggggttttttttttattttcgcggggattttgttatcggtttagtgtggaggttttatcgtttcgttcggattcgtggggtttcgatagtgtggtttttgcgaggattttttttatttttttcgttttggggttgttgcgggagggcgttcgggtagtattaggttttgagtgtttagggttcggtaggggtttttcgttgtcgtttttttgatttcgtcgtttgcggtttagggttgttggttttttcgttggtttgggaggttttagtatggacgtcgtgaggcg

SEQ ID NO: 11166 - DNA, 1503 bp, Artificial Sequence
  Description of Artificial Sequence: Synthetic polynucleotide
tcgagtgggacgaatttttcgttagttttgggtttttttatttgtcggttcgcggtcggcgtcggtataggcggagggcgtttttttttttttgcggttttaagttaagtggaagatttttttttaagttttttttttcgaagtttcgcgggtttttcgcgttttagttttagttatagtttgtggaggcggtatttcgaggttgggcgttcgtgcggcgttttggttttagtatttttcgtttcgaggttcggtttcgggggcgcggtcgttcgggttttcgtgtgttttagggggtttcgggtcgcgagtcgttgtcgaatggtttttgataaaaaaatttttgattattaaggttagtttttttttgaaagtttcgttcgtttcgatataggaagtagaagggagcgagagttttagagcgcggcggtagcggcggtttggtttttttagagggttagagttagggatatgcgggcgttcgggatttcgcgtttcgcgcggttcggcgtttgagcgttttcgtttttcgtttcggagttgtcggcggtatgattcgatacgtcggggcgttcgcgcgcggggattttacggggtaagttcgggcggtcgtttttttttttttcgcgatttttacggttcgcgttttggtcgttttattttattttttgttttagagagtttttcgggcgcgtgatttcggggttgtcgggttgatacgggatttttatcgtggtcgaggttagaatttggttttgcggggtagggggcggttttggtgatttcgttggattcgatgttggttaaatttttaaggttaggtattttattgggaatttagtgtatattttaggttgttggtggacggattacgagggagtgcgtcgttatttgttagcgtcggggttgttcgcgtggacgcggttttttttttggcgtttgtttcgtttgaattttgtaaataaaattcgcggttttagtttcgttagtttgttgtattcgttgttttgcgagtcgtagcgcgcgttttcgggtattagagtttcgttgggcgtggggtcggagattcggattttcgtaattttgggtgttcgcggtttaatagttgatcggtttttttggatcgagggtttattgggtttttttttcgtcgtttttttgttttggtcgtagacggtgattttcggatcggttttggtcgagtttagtgtttgggtagggtttagggcgtacgggttgcgcgcgggttgtggatgtatgacgtcgaatggtttgggaattgatttggagaggagttttcggtggttaagttttcgtttcgtttttttgtcgtttttagttttatttcgcgagttcgggtattgttcggggttgggttttgggagaaagttttttcgttttgtttagtttagagggcgttttgagaagttttaggtgttgtagagacgttcggtcggaggcggattttcggggaaagtttatttttgggtatttaggagcgcg

SEQ ID NO: 11167 - DNA, 907 bp, Artificial Sequence
  Description of Artificial Sequence: Synthetic polynucleotide
tcggatcggtatagggggacggttagacgggatgtcggaagttaagggacgtagaggtcggcgggtggcggcgatggagaggatagattcggtttttagaggaggtcgtgagcgcggggtttgcgtcggtcggaggagggattcggggggttgtaatatggttgttcgggcgtcgttttttttttgttaagttagggttttggggagttgttgtcgtttttcgttcgggttggggcgaggaaaggaggggacggcgttgcggtttcggaatttgtattgcgattttggtagagtaaacgttgtatttgtagtttcgaattgaattttttgtttttttttttttttttttttggttacgttttttttttttttttttattattttattttaattggttttaaacgagggtgaaagttgagtttgaggatgtcgttgttatagaaattgtatagtaattaagggttggggaggcggggggggggggcggtaggttttttttttttatttttagtacgcgtatatttttttttatttttttagttcgtcgcgttttttcggagatttatatcgttatttttcgtcgtagaacgggagggataggaatacggacggagggatcgggacgaggggagggttttacgtagtatagttgtttttttgcggagcgtttaggagattcgggtatttttggaagcgttgcggattgagttgttcgcggttgttttcgtttcgagggtcgggatagtattttaggagaagagggacgaagagggacgatagataaatagttggggagaggcgggggggggcggttcgtggggttcgttgggttttatttagttttgttcggagttgttcgaaatagtatttaggtttttgcgggttaggatgaaaggtacgtgggtcg

SEQ ID NO: 11168 - DNA, 1925 bp, Artificial Sequence
  Description of Artificial Sequence: Synthetic polynucleotide
tcgtcggttttaagtaggaaggcgttttcggtatattagttttttttagcgtttttagcgggttcggcgtttggagggttaaggcgggcgcgtttcgcgggtgggcggggggggggggacgggatcggtgtcgggagtttcgttgttttggcgttttttgggtttaggtttagtcgttttttgggtttttttcgcggggtcgttttcgttttttttttgtcgagacgggcgtggggtacggggtcgtcgttcggcggggagtttattcggcggcgtagacgtttcgcggtttcggggagggatttggtttgggtttcggtttcgcgtttttttggggaggagtcgagaggttgtagttggcggcggcggtttcgggcgggagggggttttaggaagcggttaggtcggagttttttattcggtcgtagttgttggtttggttagaatcgagcgcgttttttcggttttcgtcgtttttttttgtaaatcgcgggtaggaggagttttttttttagcgggttcggagtttagaggcgtcgcggggcgcggtcgaggggaggaggaaggagagcgggagcgtagtcggttcgggtttagtcgtgattcgtggggcggcggtttcgttaatttgtgggcgttgacgcggggggcggtttcgcggcgttcgatatttgttcgttcgggacgcggggcgtcgagaggttcggttaggcgggagttgcgttcggggcggtcgttgtatttgttcgggatttcgtcggtcgtttttcgcgtttatttttttcgtttttcgttttttttttttttttagtttcggtttttcgggcgcggcgtgagagtagagttcggttcggaggagtcgtttttttttcgttcgttcgttcggcgtttggagaggagcgcgttgaggatcgggacgtttgcggtcgtcgttatcgtttaggttcgtcgcgtttcggtcgggatggatttatacgttcgatgagtttcgcgtcggcggttgcgagcgtcgagtttttttttgttgcggttttagtcgtttttcgcgcgttcggtttcgcggattaggatttttgggtttttcggttgagggcgcggtcgtttcggagaggtcgagcggggacgggttcgagatggcgcggggatttagcgtttcggcggcgggcgttttgtacgcggttcgggttcggggatagtttcggagttggtagtcgttcggtatcgatggattttgattcgcgaggcggcgtcgcgttcgtgtttagttgtagttagaggggcgcgcgggtagaacgcgttttaggttcgggtcggttcgcgcggttatgaagatgatgttggtgcgtcggtttcgcgtgtttattttgatggtgtttttggtggtttgcgcgttgtatatcgttttggatttgttgtttaggttggagcgacgcggcgcgcggttttcgggggagttcggttgttcgtgcgcgtagttcgtcgtcgaggtggtcgcgttcggttgggtttaggttcggggtcgtttcggggagttttcggtcgtttttttcgtcgtcggcgacgcgggttggtttaataagtatacgtttcgtattttgtaggattttagtttcgattttttttttaatttttcgttttattcgttggagaaattgtcgttcgcggtcgagtcggtcgagcgcgttttgcgggggcgggatttcggcgttttaagattttacgatttcgcgtatcggtcgttgttgcgagatttcggttcgcgtcggttcgagtcgtttttcggtttcggcggagacgttttttttttggttaggttgttcgagtattcgttttatcgggtggcggtttcgtcgtttacggaggaggacgttttgtttaatgtgaatagcgatattaggtttagttttaaagcggcggagaattcg

SEQ ID NO: 11169 - DNA, 1287 bp, Artificial Sequence
  Description of Artificial Sequence: Synthetic polynucleotide
tcgtggttcggaagtggattttgttcgacgcgggggtggtcgttggagggtcgaggatgtttatataggtttttggagggtgtgttttcggagtttgtttcgttttttggatttatgggggattagtaacgtcgttatatttttttttgtttttgttagtcgttttttcgttttttttttttggttgaggttggtaaaggtaggtaggtatgggggggcggggttttaggagggaggaggggttggtgggcggggtttacggatatttcgtttcgtttttagtggggtttcgtattttttatatttcgcggtttttttaggttagggttttttattatcgcgtttagaggtcgggttagtcgggcgtgtattttaggggcgtttcgtttttcgcggtttgggattttttagttaggatagtataaaatttttttatcgtttattttttgtaaaaaatcgtggttttcggcggattttggagataggaggtgtaaagggcgtttatacgcggttcgggttcgcggtcgagagttggggggatttggagcggggtcgggtcgtaagaagattttgattttgtttcggcgttggggcgcgtgttaagggttcgcggggtattagttgtattttcgaatttttgtgtttggtcggggagtttttaaggttttatttcgttttggagggggttgcggaagttcggaggtgattcgggttttgggaggggcgtttttaacgtgggggaagggagataggggttttcgaagatagcgcgagattcggagggggttttttcgatttaagacgtggtaaattgaggtcggcgaggagcgaggttgagttcggggattaggcggttttttattgttttttcggttcgtcgtttttttgcgtttgttcgtacgggtagggtcggcggtcgagtttagcgggttcggggttaggtttgggtttcgggggcggcgttttttttttcgcgtcgtttttatgttcgtttttcgcgtcgttttcgttcgagttgtttttttttaagtagtcgttatcgcgtattttgtgttggggtcgcgggatgcggggttggcgcggggttacgtttcgtcgtagtttttgttttattcgtaggtaggagatcgcggttattattagcgttattagtagtatcgttagtttagtttgggcgtaaggagagggatgttagggattcgcggtcgtttcgtttcgtatttttttcgtttatatttttcgttgagataggtttttttttttttcgggagtttttcgggttacgcg

SEQ ID NO: 11170 - DNA, 2906 bp, Artificial Sequence; identical to SEQ ID NO: 6464
  Description of Artificial Sequence: Synthetic polynucleotide

SEQ ID NO: 11171 - DNA, 2146 bp, Artificial Sequence
  Description of Artificial Sequence: Synthetic polynucleotide
tcgcgtgttaggaaaagttgtgaggttggaaatttcggagtaaggttcgattttggttagatttgtaggttgcggaatcgggggcgcgcgggcgtagcgtagtatagttcggttatggagtacgcggtggttttttgcgttttttatttagggattgagttcggggttgtcggggagagcgagagcgagggcgtcgcgttttcggcgtagatattttgtagtttcggcgcgtttttgtgttttagtttcggggaagagttttcgtcgtagtttttcgttttagcggcggaaggcgcggttattttttcgttttttagcggtggttcgcgggtggtggagcggtagtgggaggtcggtagcgcgggcgtcgcgttttcggaggagttcgcgttttttgaggagcgcgcgtgttcggaagagttcgcggcgtcgtttttcgaatcgcgcgtttggtttgaggatttcgcgtttttcgaggagttcggggagttcgcgttcgtattttcggggttcggggcggtgtacggggagtcggatttggtgttggaggtgtcggggcgtcggttgcgcgcgtataaggcggtgttggcggcgcgtagcgattattttcgcgcgcgcgcgtcgcgggacgtgttgcgggtgtagggagtgagtttgacggcgttgcggttgtttttcgtcgacgtttatagcgggcgtatggcgggcgtgcggttcgataacgtggtcgaggtggtggtcggcgcgcgtcgtttgtagttgttcggcgtcgcgtagcgcgttatcgacgtcgtggggtcgtagttgagtttggttaattgttacgaggttttgagcgcggttaagcggtagcggttgaacgagttgcgcgacgtcgtttattgttttatgagcgattattatttggaggtgttgcgcgagttcgtcgtgttcggtcgtttgtcgggcgtagagcgggatttgttgttgcgtcgtcgtttgcgcgtcggtcgcgtttattttttggtcgcggcgttcgggtcggcgggggagcgcgcgggtagtcggttttagagtttttcgggggacgcggacgcgcgcggggacgcggtcgtttattgtttttacgcggcggtcggagagtggcgcgagttgacgcggttgttcgagggcgcgtcggcgcggggttgcggtttgtgcgttttttataattattttttcgtggcgggcggcgtggcgttcgcgggtttcgacggtcgcgcgcgttcgttcgattaggttttttgttataattcggttacggatagttggagcgtcgtgaggtttttgcgttaggcgcgttcgtagttgcggttgttggttttggacggttatttttacgtcgtgggcggcgagtgtttgtttagcgtggagcgttacgattcgcgcgtcgatcgttgggttttcgtggcgtcgttgtttcggggcgttttcgtcgtggcgtatgaggttattatttgttacggcgagatttacgtgttcgggggtttttttttttatcgtttgtttaagtatgattcgcggcgcgacgagtggtaggagtgttcgtgtagtagtagtcgcgagcgttcggtcgatatggtggttttcgacggttttatttatcgtttcgatttgagcggtagtcgcggcgaggcgtaggcggcggggtcgagcggggttagcgtgtttcgatattattgtttggttaagtagtggagttcgtgcgtcgcgtttttgcgttttttcggcggttttacgggtttgtagttttttcgttgcgtcgttttggacggcgttatttattgcgtgagtcgcgcgggtatttggcgtttttagtttgttcgggaaggcgaggtcggcggcgacgtaggttagggcggcggtttcgaggcgttgggcgtttttttggacgttcggggtgtgtttatttcgttcgtttttagtttgtttgagaagtcgtttcgaggggagtagggcgtttcgtaggtcggcggggtcggcgggcgtttttttcggtaggggtttgcggggtttaggtttttttgggttcgcggaggaggacgtggtggggagtcggggtcgttggttacgttggtggtttggatatttcgaaggagtttcgaggacgtttttagggtcgttttcg

SEQ ID NO: 11172 - DNA, 865 bp, Artificial Sequence
  Description of Artificial Sequence: Synthetic polynucleotide
gcgttttgcgttttttttttacgttatttgttagggagtcgttaaatagtaagatcgcgcgttttgcggttttagagtgcggatttcggtcgcgtgcggttttgatcgcgtcgttttatttttggcggggttacgtacggacgttatggttggcgtcgcggagtcgggcgatgcgcgcggattttttcggggttttgattgtttttgagttttttttgcggggggcgtgcgcggttcgtttttcgcggcgttacgcggttttttttcggtcggggattggtgcgttgggcggggcggggcggggcgggataaaggcgcggggtttggttgcgcggggtttgcgggtagttttaattttgggttcgtagtttgcgttgggtgcgtaggaaggttagtgtgggggtcgttcgatatttttttttcgcggaggtgggagtcgagttatattttggagtggggattggtcgcggagcgggttgtttagggtcggtcgaggtcggggcgagttttgcgcggcgttggagattttgtattttcgggcgcgcgtagggttttcggtcgtggtcgtagagttaggaggggcggtttcggagttcggcgcggggagggtttaggcgtagtcggggttggtagggcgcgatattcgtttttttttatttttgaaagggttttttacgtcgagaagaggggcgggtatggtcggttcggcgaaatcggtttgtatagattttgggaagttatcgtttgcggagggtgggattttatagtttgtttatttgtttaggttgagatttcgtgttttagttttggatgttttacgggtttttcgtttcgggtagcggcgtacgggaggagaagattttcg

SEQ ID NO: 11173 - DNA, 865 bp, Artificial Sequence; identical to SEQ ID NO: 11172
  Description of Artificial Sequence: Synthetic polynucleotide

SEQ ID NO: 11174 - DNA, 1463 bp, Artificial Sequence
  Description of Artificial Sequence: Synthetic polynucleotide
tcggggggtcgcgggacgtttaggaagcgaagcggggaaggtttcgggcgcgtcgtaggattcgcgttggagatgggtttgaagttttgttttgaaaaagtcggttcggagtgggttgttttcggtgtttttcgagtttttatgttgttatttaagtagtagaggaagaatcgggtttggttcgggaagggtgggtttagggttaggggtgtaaatttttcggtaaaagtcggtaaattaaaagtcgtatatattttaggtttcggtttaggtttcggcggggtagggttttcgaagtttcggggcgcgtagacgtcggggttttcgggggttaagggaacggcgggattcgatttttttgttttcggtttttcgggttttcgtttttcgattagtcgttgagtcgggggttggggtcgtcgttttcgttcgcggttcgttgttttttttcggcgcgcgttattcggtcgtcggttttttttttcgcggggggtttcgtttcgcgtttcgttttttcgggttgtagtcggtagtttacgtttagggagggtggagggaggaggagaggcgcggagaggagggaggggagaggggagggaggaaggcgagagaaagggagttgtttttatttcggattttttagagtttgtttggagcgcgtatttagcggttttcgggttttagcgttttagtcgcggttcgcgttttttcgtttcgttttttttttttttttttttttttttttttttttttaggtattttcgttttttttttttagcggttgtagtttttagttttaatttttcgcgtttatttttgggacgcgcgttttcgttttattttttgttttttttttttttttttttttttttttttttttggttttcgttttttttttttaggtcgttttttcggggttcgattgtttcggtgtttcgttttcggttcgcgttttgtttcgttttttttttgtattttttgagtcgttcgtcgtcgtcgtcgtagattcgtcgcgggagttttagtttaattcgagttcgatagttattgtttcggttttagttttagttttatagttcgcggcgttcgttcgagggagtttcggcgttcggggaaggttttagtgggttagcgcgttttcgtttagtttcgcgttttagttttgttcggttcggcgaggaaggatcgggaagatgaataacggcggtaaagtcgagaaggagaatatttcgagcgaggttaatttttaggaggaggaggtattgggcggttcggtgtggtggcgggggcgacgcgggatttagtgcgggcggtcggcggggcgcgggttcggggcgcggcggtggaagaaggtttaggtatggttcgtgtttcggacgtagttttatagtgtggttcggggagggtggatttcgggagcgtgtgtttttgtgtttacgcgcgtttgcgggttttaaattgcg

SEQ ID NO: 11175 - DNA, 1437 bp, Artificial Sequence
  Description of Artificial Sequence: Synthetic polynucleotide
tcgtaggaatcgaggagtcggtcggtttaggtttttaaggttacggggagggggttagggcggaaaaggtagtggagtgagggtgtcgttttcgggtcgtgttaatttcgtttcgtttcgtgtcgtcgaggcggggttttggttacgtaggaggtgcgtttcggaggagggcggcgagcggttacggggtggggagtaaggggcgcgcgggcggtaggtatggaacggacgcggcgtatttcgtttatcgcgggacgttcggacggcggtcggcgcgcgcggttcgtttcgagttcgagagggcggggagataatgtttgttcggcggggtagtttaggtcgtacgttttcgttcgcggatacgggtcgtttttattcgggcgagagggtagcggcgggaaggcgtcgggagcgatggttatttcggtttcgcgaggcgcggtaggtttcgttcgttttttttcgcgttcgtttggcgtgcgttttattcggtaagtttcggggttatagatttatttttttttttagggcgtcgtcggagttcgcgtcggagtcggtgtcggtgttgtcgtcgtgttcgtcgttcggttttaggttgtttatggtgcgggggagggggcggcgggaaggaacgcgagggcgagcgcggcgtcggtttcgcgggaagtgggaaggggcgcggggagcggtgcgttcgcgggtgcggagcgggtggcgggggatttacggggtagtgagaggggtagttttcgcgtcgggttagggttatattaagtttggcgggtgcggaaggtggggagggggtgcggcgggggaggtagtgggagtcggaggggtcgtcgttttcgtttttttattgcgatcggcgagtgcgttgcggcggcggcggcggcggtagcggcggcggggggcgggcgtcgggggagggggcgggcgtcggcggcggggggcggggtcggaatcggttttagttggggttcggttagttttttttttcgttcgtcgcgcggttttcgggggaacgcgtagttaatttttatcgtttatcgtgggttcgtttcggtttcggtcgcggggcgtcggttttcggtcgggttttttttttttttttcgtttgggttagcgttttttttttttttttttttttcgcgtttttttttacggcgagtttttaaattttgatgaattcgttcggcgaatttttttaaaggggtcgcgcgttgcgcgttttagttcgcgggaggtggagtttcgtgtttcgtatttagcgtttcggtttttgggcggttttgttcgggcggtttcgcgtttagggtattcgtagcgaggttttcgggtcgtcgattttttttgtattttgatttagggttttggggttttcgacgtatttattttgtttttaaatttagtcgcgtagattttagtttcgggggatcg

SEQ ID NO: 11176 - DNA, 717 bp, Artificial Sequence
  Description of Artificial Sequence: Synthetic polynucleotide
gcggtaggggcgggattcggaggcggggcgtttgtttacgtcgtttagtagcggagggaggcgcggttttagtttcgcgtttaggagtcgtataggcgttcggggtcgtagtaggagtttttttagggcgtttagcgttgtatttacgagtcgcgcgtcgttttcgtttagtgcgtttaggagcgtcggtagtagcgtgtttacgtgtcgtatttgttgggattcggggttagttttttgtagatttcgtcgcgatcgggttaagtttttttttattttttttttttttttatatttttttgcgatttagcgcgaggtggtttaggtttagtaggtttaattagcgtatagtgggttcggggtttttttgttaggtgaggagtcgttttaggatgattttttttcgtaggagtcgtgcggtgggtcggttttgtaatagttaggcgaggtatatggggttagtacgttcgcggttttcgtgtaggtcgttgcgatttagggattaagtttagggttattttttattatttattcgggaagtaggtttatttttgtgaagaaggttatagtcgtgagacgttgcgggtcgttcgcgttgcgaagtcgagggagtaagtttgcgaagaggtttcgtaggtggtggtcggtatgtgttattatagtattggggtgggtggaaatgggagttttcgtttcgtttggcggttttttttttcg

SEQ ID NO: 11177 - DNA, 1713 bp, Artificial Sequence
  Description of Artificial Sequence: Synthetic polynucleotide
gcgttgtagattcgggttttttttttagtttacgcgtaagtcgggttcggtttatatttattatattttttcggttttcgtttagcgtcgttttttttttcgggtttttttagtatcgatttagtatttattagcgtcgtttttaggtttttggtttagtttattttcgggtacgtgtgagtgtgtgtttgtgttagtttgttagttttatcggggatcgggttcgtttatcgagagagaagcgttaatttttgttttagtattatttttagtttttggttttgtttggagatttagtggtttatttcgtgtaggcggtagtacgtttttagtattaatttgaagttcgttacgaattcggtgatgttttcgtattggtcgttggcgaattttttttttatttgtagtagatatatgttttgttcgggttgttgcgggaaggcgcgatcgtttcggttttcgttgcgcggttttttcgttattttttttttcgcggtggtaacgttttttaagggttgtagaaagggggcggtgaggtttcggtgttttttttgtaggaattcgtttaggatgcggtagttttgttgtagttcgtaggttagtttttgttttttgtagtaatcgttttcgattattatcgtttttattttttttttttgatcgttcgcgttttttagcgaggaggtatttttttcgtgggtcggttttgaggtttgggtcgtcgttgttatttttttttcgtcgttttttttttcggtcgtcggtggcggtcgttttttttttttagtcggttttatcgttttcggcgtttcgggtatatttatgtttcggtaggtttaggttgggcggtgtggaatagtcgttcgaggtgttgggggacgcgtgagcgcgagtcgtttttttacggttcggtcgcggcgcgtagttttcgttatatcgggtttggttttttttagtcgtcggttcggttcggtgcgcgcgggggttttgagtttatcgtcggcggggcggggttatatggcgcgcgaggaggggggagagaagaggagagtttaggtgttttttttttttttttttttcggcggcggcgcgcgtacggttttcgtcggttttattttttcgtatttcgttcgtttgttttttatcggttaggttttgtcgggtcgtcgcggtttcggcgttttattttttttcgggttagcggggggttgggagggggcgaggaggaagggggtttttttttttttttttcggagggggtcgtagcggcggtttcggtttttttttttttttatattttttttcgtttttttttatttgcgggggatacgggtagaaggaggcggtgtacggacggggttcggcgataattgttagttagaagtttcgttgggcggtgaggggggagaaaggggaggggtagggagagaagggggagggtatttagtttttcggttgggaagagttgtggagagaagtaaagaaagaggttttgtcgttattttcggtgcgtatgcgtagtagaataattttttttttttttttcgttattatcgtgtttcgtttcgttacgtaaaaggaagagtttcggtttagttataggtttagaagtttgttagggttgcgcggattaatgatgtaattaatcgtaggttaatcgaatatgttgatggagggggaagtaaggcgtttgcgtagtttaattcgttatcg

SEQ ID NO: 11178 - DNA, 699 bp, Artificial Sequence
  Description of Artificial Sequence: Synthetic polynucleotide
gcgcgttcggaaagtcggtttgggttttgttaattattttgaaggtaaagtatttgtatttttttcgtcgaggttggttggcggcgtcgcgttggaggggaggaggttcgggaggaggaggagaaagagtagcgggaggattcgggttgggaggggagcgtagggttggggaggtcgatgagcggttttcggtttttcggagaagtagtcgagacggtaaggaggaggcgaggttttgtcggggcgaggcgttgtttttacgcgtttcggtcgtcggttgcgggcgcggttgggcggggagtcgaggcggtcgttttcgtattcgttcgttcgttcgttggcgtttttttttcgtttcgttcgtatttataggtatatattttacgtttttagtagttgtcgttcggttttacgtatttatttgtatttttttaacgagttatttgatggttgttagcggcgtgggtttcgtttcggcgggcgggggtcggggcggggagaacgcggcgcgggatgtttcgagcgttcgttggggagagaagcggcggcggcggcggcgttgcgggcgcgttagatggggcgggaggaggggagattcggtatttatcggtttagagttgtttgacgcggtttgggcggatttcgtcgttcgggtgtttaggtacgattttagggatttagggtaaagcggttcgcgcg

SEQ ID NO: 11179 - DNA, 1191 bp, Artificial Sequence
  Description of Artificial Sequence: Synthetic polynucleotide
tcgatttttattaagcggatggttaagcgttattcggaagtgtttattggtgggggcgggaaggtatcgtagtttaaggtattcgcgggtagggagcgggttagggcgtgcgcgaggtcgggggtagttgggaacggaggaggaggggttcgttcgaggtttcgttttttatcggttgcggtttcggttatagttagggtttagagggtttcgagtttcgggagcggaggtcggagtcgggtttttgtagaggttgtttttttttgttttcgttcggacgtggttttcgttgttcgaggtgtagttgtagtagggttcggcggtatatggtttttagttttttaagtcgggtttttagggttttggggttgttcggttcgttttttcggtcgttgtttttagtttttcggttcgtgttggtttttttagggattcggcgtgttttcgcgggcgtttcgttgtcgttttcgtcggggagtcgtaaagtttgacggaagaggttgcggttttcgcgttttagtcgtcggttttcgagtcgtagtcgggcgtttttttgacgtagtcgcgcgttttgtcggttttattcgtttcgcgtacggatggtttttaagtggttcgtcgttaggtcggtaaatcgtttttttagttgttgtcgggcgtcgttcgcgcggtttcgttagtttacgtcgtcgtcgtcgtcgttggggttgtttttattatgagttcggtcggagcggtttggttttcggtcgttcgtagtatcgttttcgtcgtagtaattttcgcgtttagtggcgttattacgtatgcgttatatcggttttattttaatcgcgtcgttagtttcgtgggttgaggggtcgcgcggttaggcgcgggtaagttcggggttggtagggcggtcggggtgacgacggaggaggagaggaggtcgcgggcggcggttgttggtttagagttaaaggaggtcgggaatttgtttagattgaggcgtgttttgttttttgtggtggagttgttttttgggtttgttttttttaggttgcgttgatatatagttttttcggggagtgttttgttgtttagtttttcggttgcgcgggaaaaagcgtgtatttttagttgagttgtgttagggcgttttcgtgtaggtttgggtattgtaggaattagtcgttttcgttcgtttcg

SEQ ID NO: 11180 - DNA, 536 bp, Artificial Sequence
  Description of Artificial Sequence: Synthetic polynucleotide
tcgttttttacgtgttcgcgggggggggcggggtcggtggattgggcgtgagttaattggttggggggcggggtattacgggttggtttcgtttaggcgttcgcgcggatttcgggtggaatgacgggagggagtttcggtagtttttattttttagcgatggcgtcgttgtgtcgcgtttagtttttagtttgtcggtcggtatttatcgttattcggagttcgtttagacggtgagatttggggcgggttcgaggtagcggcgggacgttatttgcgatcgggattatgaggagttgttagattcgtggggtcggtaacgagagtagtcgcggtatttgttgagaggaaagagggagcggttcggcgcggttggggcgcggtagaggtttgttcgattttcggttatgttattgttttgcgtgcgcggtgagtgcgcggattgaggcggggaggcggggtgtcggcgtagaggttttcgtatttttttagtggacgttcggtgatcgttttatttaaattttatatttcgttcg

SEQ ID NO: 11181 - DNA, 728 bp, Artificial Sequence
  Description of Artificial Sequence: Synthetic polynucleotide
tcgggcgttttattcgtcgtttatcgttttatttttttattttttttattcgggttttttaagtttttgatttaggcgttagatttttttattatatttttttattttaggcgattcgttttggtttcgggtgtttttagtttgcgcgggtcgtttttagttttcggtggatattcgtttttagttcgtcgttttttgttcggttttgcgttttttggaatttttgggtttttagttttcgtcgtttttagaattgcgtttgcgtaataatggttatagtggtgagggggttttttcgtcgagatttggggatggggcggggcgtagggaagggaatcgtcgcggtagtgtttgttcgggggttgggttggttttatcgggcggggtcggtttatttgtttttttttacgtagtgtaattgattttgttttttgggttagagatggttttgggtttcgggcgggagtatcgggttttgtagttgtatttgtattggggggttgtaggtcgttcgggttcggagtatattgtggaaggttatcgtttttttgtcgaggtgagcgcggagttggtcgagaaggggtaaaggagcggggcggagcggggttagagacgtggtttttttttattttcgtgttttttttagatttacgtggtttattttagtatcgtttttgttagagttgacgaggttttggggcgttcgggaggtttggtcgtgttggtcg

SEQ ID NO: 11182 - DNA, 1431 bp, Artificial Sequence
  Description of Artificial Sequence: Synthetic polynucleotide
tcggtcggtttttttttttttattttttgatttcggtcgttttacggatcgtagggattgttttatcgtttttttttacgtaattattagagaatttttttaaaaatatagattcgatgaggagtggttttttcgttttttttttgtgtcgagaagggatttcggtcgttaataataaagacgtttttcgttttttttttttcgtcggttcgggttcgtttttttcgcgttgcggttttcggtttagcgtttttttttcgagtcgggttgcggcgtttttaaatttcgaggtcgtacgtatttgtatttgagcggttcgggtcgaagcgtcgggtagaaggggtcgagagagaatcgtagtcgacgcgttgttttttataaggcgagattcgcgtttcgggcgtcgttcgatttttttcgtttgtagattggttcgatagaggagcggggattagggttatagttttcggcgtcggggcgaagaaggacggcggcgttttaggggtttcgtttacgttttcgagtttcgtttcgcgtcggttttgtttttttataagagttcgcgttttgttgattaacggtttcggtgcggggcgttggagcggtcgtcgttgttcgtcggttgttttcgggttttacgtttcgcgcggtcgtggtcgtagtcgtcgtcgttatcgtttttttttttggtattgtagacgttatttagatttagttaggttttttttttttttaattttgttttttttgtttttttttagtttgttaagcgcgaggttcgtttcggtagcgggaggaagattggaggggaacggaggggacgagtataatttttattgagttaggagttggttattgattggaggaaggtgttaaagttgatttcggttttagtttattagcgggcggggggagagacggagtttagttttgttttatttttattaattagaggtcgttcggtagggtgggaggcgttttgagtttaaggagaggttgagttcgtttagtaggaggcggggattgcggaaaagaagaattaataggaataaaggtttttcgtttttttgatttgatggattatatattcgggttaatgggggaatttttatttcgaagaaagtgggatttgtttttcgggtttgagaaagaggttgcgcggagtcggaggggtcgaggttgcgtcgcgtggagtggtttggtttaatagtagggagggtagagcgatgttttttgattttttagaagagttacgtgggttgatttagagtcggggcggaaaggttgcgtttgtttttttcgggttattgatagaagcgttaatttttgggagtagttcgttggttttttttttttttatttttttgtttgttttcggcgaggggtggttttgatttcggcgatgagtttttagaaaggtaacgtggttcg

SEQ ID NO: 11183 - DNA, 588 bp, Artificial Sequence
  Description of Artificial Sequence: Synthetic polynucleotide
tcgtagaataggcgcggagttaggtttttggatttgttttgttggaaggagggtcgcggagacgtaggcgtttcgggtcgttcgcgttgtttttgtttgtttcgtgcgggagtcggggtttttggttttttggttttttggtttttgcggttcgggcgaatttagagcgtattcgtacgtcggtttcggtcggtttttagcgttcgggttttacgggtcgcgtttttacgcggcgttttttagagattttttttttttcgggtgggcggcgtagcggggtttcggcgtcgcgaggatttttcgcgttagaataaaggaatgtggggagggggtagggaggagtttaggttattgagtagttttagtataattgtcgttcggaggcgtttttcggtttcgattcgaggttttcgttcgttattattagattcgtttttagtttcggattttcgtagattttatcggttcgtaggagggagcggcgtattgggggtcgtacggattcgttattggagatcgcgatcggaaggtggcgttacgcggtttttataggtttgggatttttattcgagttcgtaaagtaggtcg

SEQ ID NO: 11184 - DNA, 1203 bp, Artificial Sequence
  Description of Artificial Sequence: Synthetic polynucleotide
acgtttaattttcgagtttgtacggtgtagtatcgtttattttgggtttagggtaatttgggtgtaaacgtttttgcgggcggatcgcggggtgggtttcgggtatataggaggattagtagtagtcggtcggtaggcggagcgttgttagaggtttgggttttataataatttttataggattaaaataaacggcgagacgggttgcgcgtataatagtatattcgggcggttagtcgagtcgggggtttcggttcgcggttgcgttaagttttagaattatttagtttcgtgtttgtcgttcggggttcggtttcgtttcggtcggcgtttatttggcggtgtcgttttcggaagattacggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcgaagcggtttcggcgttgtcgggttaggggtgtcgttatcgttattgtgcgcgtttagagtcgtatacgcgttttgaggtagtgaggggttcggtattttttatttttagttcgtcgggttttttcggtttttttcgttcggggcgttgttgcgacggcgacggtcgtcgttttagaattcgtatcgtcgcggtttcgcgttttttcgtttcgcggcggcgtttaacgttttcgcgcgcgttattcgttttcgcgcgattggttgtttttcgcgacgttcgcgcgttttgaaggtcgtagcgttagtcggtttttttcgtcggggaaaggagtgcggttagggtttggcgttcgtagttgggtagattttcggtcgtttttgaggcggggacgaagggcgcgattcgttgcggttatagcgggttacgggttgcgggtttcgttttgggtttggggagtagattcgagtcgattacgtttcgggttttaggtcgttgggaggcggattttagagaagcg

SEQ ID NO: 11185 - DNA, 5370 bp, Artificial Sequence; identical to SEQ ID NO: 6514
  Description of Artificial Sequence: Synthetic polynucleotide

SEQ ID NO: 11186 - DNA, 1691 bp, Artificial Sequence
  Description of Artificial Sequence: Synthetic polynucleotide
gcgtgggggagcggggcgggtttggtagggacgttggtttttcgatcgtgggataggggttgggttgggacgcgggtttttattaggagtcgcgggggaggggtagggtcggagtttttattttcgtaggggaggggttggttcgggacgcggttttttcggggcgtaggggcggggtcgggtggtacgtcgggtttttttttacggtcgtgagggaggggtcggcggcgggggcggatttttggcggtttttttggttggggttcgcgcgttcgcggtagtttttcgtggaggttattgttcgtgttagtttttttcgttgtttcgttttttttcgttgtcgtcgtcgtcgtcgtcgtgttcgttttagcgtttttatttcgcgtttgggagcgaggagtcgttagcgttttcgtttcgtcgtcgtcgtagcgtttttaggtcgttattcgttatcgaaattttttagcgttcgcgtttttttcgggattcggcggcggcggggcgggggcggttcgggggcggcgcgcggttgtttcggggcgtcgggtttttttcggtcgtcgtacggtcgggattcggaggttgtcggttggagggaggttcggagcgcggtcgggcgcgcggcgtcgttataagttgcgttgttcgcgacgaggtgagtgcgtagggttcggcgggtcgggcgcggggttcgtaaatttttgcggggaggcgggtttcgcgttgattttttagggttcggtcggcggttcggggcgttcgaacgttttattcgtttttggaatttttgtaggtgtaggtcgttaattgttttcgcggcgttcggattggggtgcggcgcgtttttaggagtttgaataatatttcgaggtggtcgtttttcgaagtgtcggcgcgttttgcggggagagacggaggtcggcggggggtttttttgttttggggagggggaagtggtcggtaagtttagggaagcgttcggtttttttttcggtgtttttttgtttgtcgatttaggggtttgttgggtaaatttgcgttatcgcgggtttcggggatcggggtggagggcggtggcgggattttttcgttgttggggagaagagttttatttatattcgggacgcgggtcggttttttcggattcgggtggaagcgtagtttcgcggagtggggtaagcggcgggcgaggtggcgcgggtttcgtgtttgtttagtttttgacgcgtagaaattgttaaggaagtcgggagttttagtttttcgtttattttttcggtttgagcgtacggttgggttgggggtatttttggttcgtcgagggtttgtagagcgtcgttcggggagagcgtagatttgttgttgtttttgggttttgacggggcgggtggggtgggtttcgtagattttgggtttcggttttgttatttagggggattttttttaacgatgggatcggtgttcggagtggagtatggggagtgcgttttcgggagtcggcgttggtcggatatgtgataattgtgggtcgttggaggttcgtttgcgttgggatagggtttggattttacgtgcgtcgtttgtgtttcgttagatcggggtcggggttcgttttttgtaaggtttcgtgtttttttagttagttgcgttggacgttttataaaggtagggattgacgtttattttcg

SEQ ID NO: 11187 - DNA, 1223 bp, Artificial Sequence
  Description of Artificial Sequence: Synthetic polynucleotide
gcgttgttacggagatttcggtcgtcggagatttcgtcgtagcgaggttattgggtttttcggtcgcggggcgggagcggcgtcgatacggggtgttaggaggatttatcgggcggaggagggggtttgtttattttttcgtatttttttgggtttttttttcgggcggtgacgtgacgtgttgacggcgggttcgtgtcggggagttgggtcgttttttgttagtttcgagttcggtttttttttttttttttcgttcgttttattagtcggagttcggtttagtgttttagagaaaggtcggtttgtagtattcgttatcgtcgtcggtcgttcgtacgttcgttcggtgagtttcgggtgtcgtcgcggtcgcggggtttagtgcgcgtatagcggtttggtttcggtttggtcggcggttcgtaaggcgttttttcgcgttaggtcgggcggcgtggcgcgcggcgtcgagtaggtttcgaggaggtcgtagttaggttcggggaggagttcggttgtttcgagcggcggcggaggcgcgtttcgtaagcgggcgggggttgggggagggtcgttcggttgtgtcggaggcggtcgaggggtttcgggtcggtttcgcggtcgatttggggtatcgcgtcggggtgaggtttggcgaggaggcgaaggttgtaggcgtgaggtgaaggtcgtaggtcggtcgggtcgattttcgttatgtaaatatcggtgagggggggggagggacgggggataagatggcggcggttcggcgtttgttgtaggggacgatagagggggttgtcgggagggggagtcgttattttggaggcggtgtttggagagaaaatttcgttatagttcgtgagggggggtgggagagcgggcggcggcggtagcggcgtcggtgacgggtttcggaggttcggcgcggcggcgtgtgcgcgcggaggggcgtgttcgtttttcgtggcggttattgtttttgtcgttatgatgagcgttcgggttttaggcgttcggcggtagcgttatttttttgttttgtttttcgtagtttcgtgattggttgtagttttcgttgcgttttagttgagttgtcgtaggcggttatcgtcgtcgttcggacgtcgggatcgttttatttttagcgtttttggttttgcgttttttttcgcgtttgtagttattcgagggtagtcggggtaggtggtatttcg

SEQ ID NO: 11188 - DNA, 1103 bp, Artificial Sequence
  Description of Artificial Sequence: Synthetic polynucleotide
acgttacgcgtcgttttgttatcggtgttttttgagtgacgttaaaacgttttggatggtggtattgggattatggatggggtttatttagtttttttcggtttgttattaaggggaggggtcgtcggtgggtttttcggcgtcgttgtaagttatcgggtttcgaagtcggaggtcgaaacggcgtgggtttcgaagcggggtcgttttttagggagtgcgtaggttagcgaggatttcggtgaggcgagacgttatttttatttggttgtttttgttgtttttatttttttagttttagtcgtttgtagtgattcgtgattttcgtaggtttttaaggatcgttgcgcgagggagggggttcgaggcgttttcggttcgtttttttttcggttttcggattcgagtcggttttcgggaaagagtttgttatcgcgttttcgtagttatttttttcgcgtgttcggttttttttagtggcgggggtacgtgggcgcgcggggtgcgtggtaagtcgtttttttttttacgttcgttcggtcgtttttcgcgcgcgcgtttcgtatatagttttcgtgtagtgggtagagttcggtttcgcgcgcgtttcgtttcgtttttggttagtcgcgttcgttttcgcgtttttgttttttttttttttttttttttcgttttttaggcgcgtattttttttttcgcgtttttttcgcgttttatatttatcgttcggcggagggggtttagttcgtagtcgtcgtcgttatcgtcgcgtttcggtttcggtgtaggtagcggtcgtcgtcgtcgagatagttgcgcgggcgagtatttttacgtagtaagttcgtttttttttcgtttgtgcgcgcgtgtgtgtttttcgttcgtcggcgttttgggtttcgggggagcggttgtttttttgtttcgtcgtcgtcgtcgttcggggttggtttttgcggtttcggttgtttggttttttagggttgggtattgcggtttcggcggtttcgttgaggtcgggggttaggggtcgtttcgggttgcggggtgcgggacgagggattgcgagtgcgaggttttttttggtgcgtgtttcg

SEQ ID NO: 11189 - DNA, 616 bp, Artificial Sequence
  Description of Artificial Sequence: Synthetic polynucleotide
acggtagttttcgattgaattaattcgatagtatttgtggaagtcgttggttttgtgtcggggttagatcgcgtaattaggagcgggggttttttacgtggcggaggtttttcggtttgggggttacgggttcggaggaatttgtttggaagttttttattacggtagagttttttggagttcgtttcgtgttcgataaggggagttttagatttgatttttttagtagtttcgcggggcggggtcgagaaggggcgggcgggcggaggacgttggcgggagaatgtgcggaatgtgttaggcgtttttatttattttaggaggggtagaggaaggggtcggtcgaggggaggggcgaggggcgaggtttcgggcggtcggagaaaatttgtttgtttttttgcgggcggagtttagttcgcgttttttcgtttttttgcgcgtttttcgttgtgtatcgcgtttcgcgtttcgcgtttgttttttcggttcggttcggttcggtcgggtgtcgtttattcgagggagttcgcgttttgcgattgttcgattttttattcgttttacgagtcgggtatcggtgttaggtagggttgtcgagtcgttattggatgcg

SEQ ID NO: 11190 - DNA, 206 bp, Artificial Sequence
  Description of Artificial Sequence: Synthetic polynucleotide
gcggcgggcggttggggaagtagttttgtggtttttcggcgggtgaggtcgagatagagattaatttttaggcggcgttttggcgttgagttcgcgttgaataagattttttcgtagttttgcgtttcgcgtcgggtgaaggggcgtgtttttgtaggcgttcggggttcggtttggagttggcggtcggtacgtcgtttttggcg

SEQ ID NO: 11191 - DNA, 1141 bp, Artificial Sequence
  Description of Artificial Sequence: Synthetic polynucleotide
tcgtagtttgggagcgcgcggtttcggggatggggagggggtcgggaggaggcgtgcggttttgggggcgcgtattgcgggagcgcgcggtggcgaggatagggcgggtcggggttcgcggggcgaaggcgcgcggtgttcgggggagggcgggtcggggcgcgcgggtcggggcgggggcgcgcgggtcggggcgggggcgcgcggggtcggtcggcgcgcgggggcggcgggcgcggcgttgttaatcgtagataaaggtcgttttagtgaattatgtggtgtcgggggaggaagtgcggtttgtttttttttttttagtttcggggttgtaggttgagcgcgatgcgcggagattttcgcgggggcggcggcggtcgtgagtttcgatgaggttcgagcgttttcggtcgcgcggtagcgttttcggttcgatggagatttcgtcgtgggatttagttcgtaacgattcgttgtcgtttacgttgatttcggtcgtgtttttttacgtgaagtttggttttatcgtcgtttatatcgtgttttacgcgttgtttttcgtgtttatttacgtgtagttttggttggtgttgcgttatcgttataagcggtttagttattagagcgtttttttttttttttgttttttttgggtttttttgcggatcgtttttttttttttttattttaaagatttcgtggcggttaattcgtttagttttttcgttttttggttgttttattgtttttttgtgtgtttgtagttttttatttttacgttgatgaatttgtattttacgtaggtgagttttagagaggtttttggaggcgtttatttggcggggtggttttcgcggggcgttcgaggtaggggcgatggtagtcgcgggggcgggttcggttttagggttgagagtgtagggagaaggcgtcggttttggggtcgttcgaattttgttttgtttgcgggtatttgttataggaaattttttgttatttttaaaaggggtaaggagaaggtaggggagggttggaggtcgtcgtttattcgttgtttttggtttcgtatcgtgcggtggattcggggcgttttttcgtgcgtagcgcgaagtagtagcgtttgtatacgttagttagtacg

SEQ ID NO: 11192 - DNA, 1819 bp, Artificial Sequence
  Description of Artificial Sequence: Synthetic polynucleotide
gcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcg

SEQ ID NO: 11193 - DNA, 1813 bp, Artificial Sequence
  Description of Artificial Sequence: Synthetic polynucleotide
gcgtttagtttcgagagtttattatagtttacgtttgggcgcgtagtattttttcgatattgtttttgttgtgttagatagtggtagtgttgagtttaggaatacgcgcggagttcgcggcgattttcgcggtcgtttagttttcgcggcggatttcggcgcgtaggagttattgggtcgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcgatggtggaagttttgggttggagggttgggagtttattgagtttcgtttaatttgatttatttttttttcgtttttcgttttttgtattttttttcggttttgtagtcggttggcggggttggcgggtttggcgttggtggagtggattcg

SEQ ID NO: 11194 - DNA, 1872 bp, Artificial Sequence
  Description of Artificial Sequence: Synthetic polynucleotide
gcgttttgttagttaagtcgggtagttagggatttacggagtaaagatttaagcgggtatggtttcgataaagagtgaggttcgttttttttttgttgtttcgttagttattaaagatgagtgaggcggaaatacgacggtggggagcgcggggaatggaaaagttagaaggtttcgtaataattcggtgttatttgaatgtttgtaaaacgtgtcggtaaaggtagttatgtttttatttcgattttggtttagttgttcgggatacgcgttacgcggcggtcgttaatatttaggggatagataatagttatattgtattgatagtacgtagataatatcggcgaggtgtatatttatatatttaacgataggtttcgttattgcgaggcggttgttaatttggagggaatagggaaagttagtcgggttttagtttttttttttcgaagtacgtttatttaaacgtcgtagtttgcgtttaggttgttttcgttttattttaaagattatgttaacgtaggaattgtgggtgcgcgcgggcggttcggcggggagtttttttttttgggtttcgtcggttttattttgggagcgggagggggaggagggagggttggaggaggggaggggaattttaaattaaaataatttttagttatgaggacgttcggtggtatcggatatttatattagtaatagttatattatattcgttttcgttagatggcggcgggtttaatttttcgggatttcgtaaatttaggttgtgcgttcgagcgcgcgtcggagtgtgggtacgcgggcgggttggggattgcgggagcggcgcggcgcggcgcgagttcggggcgagaacgggggcgtggggttggggggcgtcgggtttatcggtttcggacgaggaggttttcgttttcggggagcggtatcgggtagtttcggtttagggtgacggtttcgcggaagttggggtttagtcgggttattattagtttttgtatggtttggggaatggcggagttttggaagtttaggaagtggcgggcgtacgatatgtttacgatggttcgggtttcggtgggtattagtcgtagtatggtttgcgttttcgttcgttttttgcgtcgacgttggtcggggtcggttttcgttcgggtcgttcggttcggttgtgttttgttcggttagggcgggcgggttcgtttttttttcggtcggcgttttttttttggtttttttttttttcgcgtcgttcgttttcgtttttttcgttttttcggcgtcggcgtagttttcgtgaattcgggcgtattatttcgggtgtttcggtttggggatcgttgtcgtttcggtcgttgtttttttaatttttttgttttggtttgaatttgttcggcgtagattggttaaggatttttttcgtttttttttttttttttggcgcgggagaggtatcggatatttttatttttttcgagttttaaaagtcggatttgatttttttcgggtaagggtggcgggggggacggcgggtaaggggggacgggggattcgcgcgtttcgcggtcgtttgcggtttcgagtcggcggtagtttcgggcgttttcggagttgcgcggcggtcggcgtaggcgtttttttttttcgtgcgaagcgtttatttttttgtaaggtggtacgaattaatttcgagcgcggttcgggcggcggggtacgatcggggatttcgggtagggcggggagtttttgtcgtcgttgtcgtacgcgtattcgtatcgatcgcggggcggggaaatgtttagtgtttttcgttttttaggttggtggttttttgttttcggaattttttgcgcgtgttttttgtttacg

SEQ ID NO: 11195 - DNA, 652 bp, Artificial Sequence
  Description of Artificial Sequence: Synthetic polynucleotide
tcgtagatcgtgtatttttgtagggggtttcggatgcgatggagttgcgcgagttgacgttttgggttgggcggtttttaggttcgcgtcgtcgggcggggtttcggcggcggcgcgcgcgtgcgcggttgggggcgcggttttgcgggttgcgcgagttggaggtgcgcgtgagcgagttgggtttgggttacgcgttcgacgagacggtgttgtttcgttattgcgtaggcgtttgcgaggttgtcgcgcgcgtttacgatttcgggttgcgacgattgcgttagcggcggcgtttgcggcgggagcgggtgcgcgcgtagttttgttgtcgttcgacggtttacgaggacgaggtgttttttttggacgcgtatagtcgttattatacggtgtacgagttgtcggcgcgcgagtgcgtttgcgtgtgattttattttattcggtcggcgcggcggttatttttttcgtttcgacggtattattggtcggtttcgcgaaagattgcgcgtgcgtagagtacgtcggcgcggtttcgggattttcgcgataattgtattgagataaagtgtggtaattcgagttggttggtgatttattttcggcgaggggttcgcgtgtgggttacgtcgtcgtttttatcgggaaagcg

SEQ ID NO: 11196 - DNA, 722 bp, Artificial Sequence
  Description of Artificial Sequence: Synthetic polynucleotide
gcgtttatttacggcgcgtgtagggttttaggtttagggagcgagcggggcgttatgggggtcggagtttgggtttaggtcgttttttttttaattttttttgggtttttttatttcgcggtttttttcggagcgtggtttatcgggcgtgaagagcgcgatggttttgaggtagttatattcggtcgagtcgatttgtaggcggtttagtttgtttatttgtttttggaaggcgcgtatttggtttatgaaagttacggcgcgttcggcggttataggcgcggcgtggaggtcggcggcggttagtagcggcgtcgtgtgtaggggtagcgtcgtttgcgtcgcgtttagtacgaagagttcgttttagtttaggcgtagtagcgttatttggtcggttatcggtagttcggggaagaagggcgcgtggcgcgtttattttacggtgttgaagagtagtcgcgtcgttagttcgtatacgttgtcgatgtttagtatcgcgttcgtcgcgtcgttttttgcgtcgaagcgttcggtcgtcgtagggtagggtttagcgcgtagtagttgcgcgattagttcggatatcggttgtttcgggaagaggttttcgtcgttcgttattgtcgttagcgtcgagttcggggggttgttcgaggaggcggttacggtattaggtagcgagtgcgggatgcggtcgcgttgtatcgttgcgggaggcg

SEQ ID NO: 11197 - DNA, 858 bp, Artificial Sequence
  Description of Artificial Sequence: Synthetic polynucleotide
acgattacgttatcgtagattagggttatacgatagatttcgtttttatttatcgttttgagttcgattaaatagtatttacggtatatattagggttttcgttttttatatatatatattataatgacgtcgtaaataatagtattaattattatcgttcgtagttttcgcgtatagaggttttaggttttcggttttacgtggatcgatttcgttcggtagcgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcgaagaaggaattggagggtcgggttgggaaggtttgaagcgggtatagtttttaggttggggagggtcgaggggagaattcggagtttgagtcgggcg

SEQ ID NO: 11198 - DNA, 598 bp, Artificial Sequence
  Description of Artificial Sequence: Synthetic polynucleotide
tcgaggtttcggcgggttttcgtatcggttttagtttttttttcgtatttgtttggtcggcgggttttatttttttttttgttaggggtagattttgggattatttagttcgttttcgtaggttttgagcgtttgacgtttgcgtattgagcgcgggcgggcgggtatttttagaaattttcggggcgttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgttaaggtaggagtgttcgggatgtcggagcggatacgcgcggagaaagcgtcgttggggttattcgtgtggtcgtgttttcg

SEQ ID NO: 11199 - DNA, 1281 bp, Artificial Sequence
  Description of Artificial Sequence: Synthetic polynucleotide
tcgaaagtttaaagtttcgggtttatcggttagttttttatttcgttgttgggtcggataggtgtaggggaggcggattcgtttcgtagtcgatttatttagttttagggtttggtcgtatttgagtagcgcggttttcggttgttgttggcgttgtaggtttcgcgtttggtttgttagtttgcgtagtcggtattcggtcgggaagtatttttttagtaggtcgtttagtattacgtttacgcgtcgtatttgcggtcgcgcgggttttggttttacgtagcgtttgtagattgtgagttcgtagggtagcgttatcggtttatgtagtagtcgtcggtagcgcgggtagtcgagtaggtcgcggggcgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcgtcggtatcgcg

SEQ ID NO: 11200 - DNA, 1788 bp, Artificial Sequence
  Description of Artificial Sequence: Synthetic polynucleotide
tcggttaggttcgtcggtcgttttagtttagtattagggcgttcgcgcggttgttaaatattttcgggagttttgttcgtaaagggattacgaggtagttgttggcgcgttttgcgcgtattcgtttagaggtttttcggtttgtttttcgcgggtttgtttcgaaattgacgtgaaatcgatttggtgtaatgcgaatgagttttcgttcgttttcgtttttattttagtcgtcgtcgtcgttcgtcgttataataatcggtttttattttttttattttacgttttgtttttcgggtttttcgggttataggttatagcgcgggaaggcgtttcgttttcggcgtttcgtattcggtcgtcgcgtattttcgttcgttcggcgttttcgagttacgtagaggcgttttttttcgtcggagacgggaaagtttcggcgtttttagattgggtttcgtttttagttttcggaggggttggggttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaagattttcgagtttaaagagattttcggaacgtaagtggggatcggggaggcgagggtggaggtggtcgcggtaggggttgtacgggtagttttagttgtcgtcgtcgttattatcgcggtagaaatttagtttgttatcgcgtttttattgtttcgttttcggcgttgcggagttttttcgagcgcgttcgacgcgtgggtttgcgattttcgggtgggcgtcgttttcgggagggggagggggtagcgtcgggttgttagggagtagtttacgcgggcgcgcgattttttattttttttgttatcgtcgtttttttcgttgttttttttttacgcgtgattgtgggttgagtatggtggggatggttgtttatcggttgtgtgcgtttattcgtcgtgtgtatgggcgtatcgcgttggcgagacgtggttacgagaagattagtttttagtcgtttttatttttgtttttatattatgtatttttatggaattggtatttgtacgtacgaggtgtaggtaagattttgggtggttacgcgaggatggaagggaagggtttcgtagtgtttagggttatacgtgggtagagttttatcggagggtttgtgtattttacgcgggttcggtcgtacgcgtcggggagcgcgtttttaagggagggtttgtgcgcgtcgttgcgcgggcggtgtttttttcgggttgtatcg

SEQ ID NO: 11201 - DNA, 626 bp, Artificial Sequence
  Description of Artificial Sequence: Synthetic polynucleotide
tcgttcggtttttcgcgtagtcgtgggatttcgaggagggcgtttattaggtcgcgtgtgattatgtaaggtaaatagggggtttatgaagttattgaggattaatggggagttcggagtagagtttggggcggggtttggttttggcggcgggcgcggattggtacgttgcggatttttttgttgttttataaggcggtgcgaggcgagttatttttagagggttatataagggggttgaggcggtcgttcggcggtcgggtagcgcgagcgtaagggatagggagggtcgtggcgatattcgcgttagttttcgggacggttgggttcgggttggtcgtcgattttcgattttttattagatgtttggtagagttcggcgcgttcggagttcgcgttttttagagggaaggggtcgcgcgtcgtcgcggcggttttgaggttgacggtcgggaggtgaaaggtcggagtgcggggttaggacgttttttggagggggcgcggcgtagggggtcgcggggaagtcgtcgagggcgcggagcgggaaggaaggatagtggttatttcgttttcgtttgggtacggggtagggattcgcgcgaggcggtgtcggggaggtttttacg

SEQ ID NO: 11202 - DNA, 1037 bp, Artificial Sequence
  Description of Artificial Sequence: Synthetic polynucleotide
acgaagttttcgcgaattgaattgagagtagataaaagtacgcgtttttttttatcgttacgtcggttttatttaaattcgcgagttattcgtatttttttttaggagttatagttaggttagaagagtgcggagggacggggttcgggaagagtagggaatttttagagttcgtagttaacgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcgttggttatgggcgagggtatttgtgagaagcgtcgggacgtcgagtatggcgttagttcggagtaggttgtaggtaacgcggtttggaataagtagttgggagaaatttggagggtagcggagaagttcgacgggcggttggattttacggacggttttaggggcggtagagtcgagattttggattaaattaagggggattgttgttagcgggacgcggaagttaggttcg

SEQ ID NO: 11203 - DNA, 977 bp, Artificial Sequence
  Description of Artificial Sequence: Synthetic polynucleotide
tcggatttgacggagtaatgtacgtgggtttttgattcgtaatatatttagttaaagtcggtttttattgttaagcgcgttagtagtttatatttattgcggtcgcggtttgatgtggtgatgtttatcgcgcggtttttataatgtagggatttttttgagtggtggtcgttttcgttttagttttcggttattcgtagttttatatcgggttattggtttattatcgagatagttagcgagtttaggcggtttttgtagcgttgggagaggaatgtgcgcgaaattaattagagcgaaattagtcggaggagtcggtcgaggtgtaggtgtaggcgtagtttcgtttagaattttttcgttatatttaagggagttggaagttcgggagggtgttgttttttttttttaggaatagagggttttgaagtgttttttttttagtatatagtcgttttcggggatttggatcgtacggcggtattataaatttggaggaggtatggaggtaagcgttttggcggcgtttttattggtaggtggaggtttttttttttttgtgttgtttttagtttcgggtatttatttttttatagataggattatattttttagcgttcggtttttttgtgtttttaaggtaggagggttagttagcggtcgggagggaggagtggtagtagagtcgattgtttgcggtcggtttgcgaggcgtgtaaggttcgaggtgtttagtaggtgttatcgtagttttagggttgaggtttggggacgataggttttggaggcgcggtaggtgtagagcgtttcggtagttttagggggtgtgttggaggggaatcgtcggtttgtttggatttttcgagtattatcgaggattttcgtcgggatttttttataattttaaatcggtttataatttcgttagagatgatagggttagggaattagaaatcggcggattagcgttagggtcg

SEQ ID NO: 11204 - DNA, 6206 bp, Artificial Sequence
  Description of Artificial Sequence: Synthetic polynucleotide
tcgtttttttgcggtaggcgaggcggggtgtaggtgtgagtggggtgggaggaaggggaaaggatcggggtcgtcgtagtttttttggttagtttcgttgggttttgttagtttcgtttgagatcgaggcgtacggattagcggtcgttagtattttataggtggaggatattttttgcgttttaaggttaatgttatttcgatgggtttcgtgtcgttttgattttttttgatttaattttttggttatgatttttttattttttgggtttcgtttttgttagttttcgtcgacgtcgtttttttcgtcgttcgttcgggtttttttattcgtttttttttttttttggttcgacggttttattgaggtaaaaataaatagttttgagggtattttaaggagcgtgtagtggtttcgacggtattttcggggggataaaagaggtggttagttacgtcgtcggttttcggtcgaataatgggcgcgtagtagattgttagggggtatttgaaattcgaggggagggaaatatttgagcgcggttttttttcgcgaggacgtacgacgtagtttcgcggatcgttttttgttcgtttttttttatgtattttttttttgtgtggaattatttaaacgggagatttttggtagttttatgttaatgcgtcgaataaaggtaacggttcgcgggcgggaggttcggaaggtgtttggggtcgggtcgggcggggtggcggttaggcgggttgcgcgtgtttttcgcgtgtttttgggattgatataataattttttatttttgtaaatataaagttttttatcggttcgggtcgggcgtattcggcgtagggaggcgttggttttttcgggcggcgggtattgtagcggtaacgtacggtttttgtcggttgtggttcgggggattgagggtcgggagtgggggtttttgtgaagttagaagagaagtttgtagtagagtggtgatgaggggcgttgatattttatttttaacgtcgacgtttttaaacgcgatattttttgcggggtgagaatgcgggttcgttcggtttttttcgtgaggttagggttttttgtttttttagatattttaaggagttaattttttcgtagaagtttttcgtttttgtttttatttttaagtttcgcgttttttataaattttttgttgttttgattttgatttttagtcgtggtgagggttagagtgaatttcggcgcgtttttcgacggtattttcgtatattaggataggagaaattggagggtttggggtttcgggtttcgtagtcgtcggaggaagaatttatcgcggggttcgtaagggaaagtgaagaggttcgggatttttttaaagcgttggttaggatttcgaaggaaggggaggagttatttgaagtcggggaaggttttttgggtgttttgttttggatttttatgtttattgattttcgcgaagtttttttggaggggggtaaattcgcgttgttttttttaatttaattttacgcggtttatttttcgaatcgcgtgcgttaaggtcggcgtcgggggcgtattgtgatggcgttttgttttttttaggcgaagataaatatttcgattcgatgtttttatgtatgcgggtgtataggttttgagaaaattacgtagaaggcggttgcgatttacggttcgggttgggttatatttgtttggaggtcgttggtgtgtgcgtgcgcgcgtgcgtagtttaattttttttagtttcgggtggtgaaattagtttttaatattagtattttttaagtttttatttattttgattgtattcgtttgaaagtagattttatttacgttagtaagattggaagttataaataaagaaaaagaaacggatttattgaattttagtattttagtagcgtttaatagatttttttggttaaatttagagttttgtttgaatttatttacgtaggagttgttttgttttttttgttggtagaggtgtcggttttttatttttacggtttatttataattatgggtgttgttatttttaaaggatttataaggtgattaattttttgttatttgttgaatggaaggagtgttatatatgtaagatcgaatggggtaggtcgagttttcgttttatgttattttataatttagatgggattcgtgattagaaaataaaattggttaaagttgtttcggaattttttttttatttttaattttattagtattattaattagagtttaaaagagtaaggaaataatattagttatttttagatagaaatatgtttataaattttagataaatttattttaagatttttaatttttggggagattagtatttattatagtatttttaaaattagggtgagattttttaaaatatattttattatatgtatttttttttttttagtgtgtgagttaaaatattataaatataaaattattaaatattttttttttgattaattaatttgattaattttttaattaattaagtttaataattgtttttattataatttatgatttatgtggattttatttttatatgtttaatttttacgttagggtatttttagagggaaaatttaaaataattaaatatttttagtggaattaagcgtaagtaaaatttagtaaaatttgtttggtatataaagttttgtagaaaaatgttttttttttttttaataaagtgatattttttttatagtatatgatattttatgtggtttggttatttgttttttagtgttggacgattagggttattacgtattcgtggggttttttgttttgtttttcgaagattttgttttttgtgttttttcggggttgggttggatagaggatggaggtaggcggtttagtttgggtttaaacggaacggtagtggaggtgggggtgggggtgggggcggggggaattttcgttgttgtttttttttggtggtataggggaggcggtttgttttttcggaggttttagtttgttttagagtatagattgtttttttttttttcgtttagtacgcgttttttttgcgtttagattggtcgcgatcggagtttaatagtaggaggttaattttttttataaaggtgaagggggtacggtttcgtgggggttgcgtttagataggtagtttttttatttcgtagcgttttgattggagtttttgatttagtatttgatgttaatcggtaaataaaatgttcgttcggaatgaaaatgtatgaggtcgcgcggggaggagaaagttaattttattggggcgtacgaggtcgatcgcgcgtttcgggtttcggttaattcgattcggattaatcgagttttggattacgcggaagtttcgggcggtttgggtcgggtttcgttaaagatgttatttttaagtttttaagaatttaaaagtttagaaatttacgtttttttgggaatttagtttagttcgttcgcgttttaatttcgcgttttcgggagattgagaaggtcgtgttaatttttttttaaattcgaaagaaattttttttagtttcgtgggcgcgcggaggttgcgagtataaatatcgttttcggttattgttagaaggtcgggttttttgtttatatttggaatttcggggaatttttttgtttggttttttgggtttagcggtttattcgtttaaggttcgggcggaggtcgttcggattttgttgttttttcggatttttgtttattttttaaatattacgcggagttattgcgttttcgtaacgatttttttcgtatcgtttcggcgcgttttcgtttttatttaattagcgcgtataatttttttttcggtttcggttcgcggattgaatttttttgatatatttggggttattttttttttttgttgttattttgttagcgattcgcgggtaattttcgcgcgggaggggggcgtgtattgtcgcgttgatggacgggtttatttggcggtttcgcgtttttcggaggagagatataaagtttaggtacgtgcgtttttttatagagaagtagtagatcgtgaagggaggcggggtcgggcgtgtgtttggatcgggcggggcggcggcgtcgggcggggcgattaggggcgcgcgcgggggtttcgcgtttttaggtatatttgtcgtatttatcgggcgattttcgagtttcggtttttttttggtcgttttatcgtttttttattttgttaggttgaggagttgcggacgcgttgattggttttaggggaagcgggaggcgagaataatggtttttttttttcgttaaaagggagcggttgtcgggttcggggatagggacgcgcgtgtagggcgtagagttgggtcgagtcgtcgtcggcgttacgcgagtttcgtagtcgtcgcgttcgggtaatgggtcgggggtattgagggtcgtcggggtcgagcgcggaggggggatcgagttagtgtcgtgttttcgggtcgcgttaatatgtttcgcggttttttggtgaagcgtagtaagaagtttacgttcgttttttatcgggttcgcggcggcgaggacggcgatcgcgtattgttgttttcgtttagttgcgggggcgttcgcgtcgagttttcggcgtcgagttcggttttcgggtcgttgtcgtcgtcgtcgttcgcggagcgcgtttatgtagcgttcgtcgtcgcgtttgtttgcgcgtttgggtcgtagttattttcgtagggttcgcgggtcgcgtatttcggtaatttcgaggttgcgtatttcgcgtcgttttatagttttacgcggttcgtgagtcgcgagtacgagaagtataagtatttcgaacgtagttttaatttgggttcgtcggtttcggtcgagtttttttttacgttcgtcgcgttgttcggagggggcggcggcggcggcgcgagcggagttggcggaggcggtatttgcggcggcgattcgttgtttttcgcgttcgtcgagtttaagatgggtacggcgttttcggttggcgtcgaggcggttcgcggttcgggtttcggttttttattgttttttgtcgtcgttttgcggttttcgggaaagcggttttcgttttttatcgtcgcggagtcgttcgttaaggtagttaaggtttcgggcgttaagaagtttaaggttattcgtaagttgtatttcgaggacgaggtgattacgtcgttcgtgttggggtttaagattaaggagggttcggtggaggcgtcgcggggtcgcgcggggggcgcggcgcggtcgttgggcgagtttatttgttagttgtgtaaggaggagtacgtcgattcgttcgcgttggcgtagtataaatgttcgcgtatcgtgcgtgtggagtatcgttgtttcgagtgcgttaaggtttttagttgttcggttaatttggtttcgtatcgtcgttggtataaatcgcggttcgcgttcgtcgtcgttcgcgcgtcggagttagaagtagtagttagggttgaggcgcgggaggtattcggcggcggtagcgatcgggatacgtcgagtttcggcggcgtgttcgagtcgggtttcgaggacgggttttacgagtgttattattgcgttaagaagtttcgtcgttaggtttatttacgtaagtatttgttggcgtattattaggcgttgtaggttaagggcgcgtcgttagcgttttcggtcgaggatttattggttttgtatttcgggttcgacgagaaggcgttttaggaggcggtcggcgacggcgagggggtcggcgtgttgggtttgagtgcgttcgtcgagtgttatttgtgtttagtgtgcggagagtcgttcgttagtaagggcgtttaggagcgttatttgcgtttgttgtacgtcgtttaggtgtttttttgtaagtattgttcggttattttttatagttcgttcggttttacgcggtatattaataagtgttatttattcgaaaatagataggtgatttttttgtaggtgttcgtgcgttcggtttgttagagcgcgttttttatttcggttttcgaattgtgttttcgtttggagatttataaagagagtgcgttttgtatttttcgaattcgagttcgcgttgggggagtttcgttttcgtttttatcgggtgaaagtgtcgttttcgtttttttcggtgtggcgtgacg

SEQ ID NO: 11205 - DNA, 574 bp, Artificial Sequence
  Description of Artificial Sequence: Synthetic polynucleotide
gcgtttttttttttgttcgcgttttcggttttttcgttggtttttgttcgagtttttagtttttttgtattataggtttttggggtttcgtttcggattcggttattttttaggttcggagtagtcgtcgtggaggtcgttttttcgcgtttaggggaagggaaggcggtttcggggttcgttgcggggtggagggattcgcgttttttagtttttcgggttcgggtcgcggggatcgtgcgcgcgtttttttttcgggtaaggtcgggcggcgggcgcgtcgcggtttttggggttttcgtttttttgttcgttatcgtttgcgggagtttttggtttggaggggttcggggcgcgttggcgattgcgggttcggcgataggggcggttggtggcgggaggatagtgggaggaaggtttcgttttacgcgtttttttttcggatgtgattcgtcggggtttttcgtagtcggggcgagcggtttggaagttcggaggaggggtacggaattgttcgatggggatgcgatcgcgggcgttagacgaattgtttttatattcgttggcgttggcg

SEQ ID NO: 11206 - DNA, 3438 bp, Artificial Sequence
  Description of Artificial Sequence: Synthetic polynucleotide
tcgttggtggagttcgtttttttgaagtcggagttggcgagtttttcgtatttgattttgtaggcgtttttttcgcgggttagtcgggatattttttgtttaagttgttttatttgttgaatgagttgcgtttttttattttttaggtggtgtttttgttggacgcgtttatatttgtaagattgggcgtagtttcggttttttagggttcgtcgtttttgttttaggcggattatttcgtttttggtgaagtttcgtaggtggcggtttagttcgcgtacggatatggatacgagttggtcgtcggagaagcggttttttacgttgtcgttgtcgttcgtcgtcgtcgtcgaggtcgtcgcgtgcggttcgggttcggggtggttagtgggtagttgttgcgtcgggttagcggcgttggacggcggcggcgacgtttggtgatgatggtgatggtgcgggtgagcgtgcgggtttagttcgtcgtgggttacgtcggcgttcgggtacgtgtggtgcgggtgagggtggtggtgatggtggtggtggtgagcgtcgcgaaagttgtcgaagttttgtagcggttgtggtattgggtgcgagtcgatgagcgtttttatcgcgttttcgggcgttaggttgagcgtttcggggtttatttgttggtagttgttcgttatttagtatagattttcgaggtgtgttttttgttcggtcgggttgaagttgggcgacgagggtacggagttatacggagtgttgagcggtgtggaggatatcgagtcggttggttgtaggcgtgtgtagggtttgttcggacgtttcgcgcgttttagtggttttttttttacgtcgaatttgagtaggtcgaagtcgttgatatattttatggttagcgggttggtgggtagttttggttttatgtttagtttcgcggttatcgttgaagcgaggcgtagtcgtcgttgtcgttcgggaaattttgcggtcggtcggagcgcgtcgagttaagcgcgggggggaagagcggagaagagttggggaggcggggagcgagggcgtagcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtcgcgatcgttcggtttacggtcggaaggtttggacggcgtttcgtatttagttaggttttttttatttggtttaatttaagttagtttagaacgtatattatgtgtgtattagagtttaggataggtttttttcgagcgatgtataggttttcgggtttcgttttcgtatttagtcgcgagtttcgagtcgcgagtttcgttttggtcgtttcgttgaaatttcgtgttttagcgttcgggggtgttcgtcggttgttttttgggtcggaaggttttgggcggaggaaggtcggtagttaaaagtggaagcgttatagtgaagcggtttagggttatcgggtgagaaattttttcggagggtagacggggagatcgaagtatatcgtattaggtatttagattgggtttgggagtcgcgtattttttttatttagatttaggatggttagaattaacgggttttttttgagatttcggtttaggcgtcgaaatcggatagatcgcgaattcgttggattcggagattcgattcgtttttcgcgttatttttttttttttagttttgggcgcgcgtagcgaaaggtaggagaggcgcgtattgggtgagtgagtttcggtcgttgtttgcgttggattagttcgattgatttcgcgcgtaggggtcgcgtgagttatatcggtgtagacgcgtttagattatttttaaatgttagaaggtaaaatatttgtttttaattaatttgaaaattttttatttttttgcgttttcggagaggttggggtacggcgtggtattgggtcgtttatttttaataaaatgagtgtattttaattaaaatttaatttaattttgtggggtggtaaattaaatgttggaagagcgcgtttataatttttttcgagaagcgtgtttttcgtagaaatgagtcggtcgtttggagagagagtttgggcggtgtcgttgcgtagtttttgttagtagttgggggttggggattcgtattttgtaaatgttttcgttttgtttgaacgtagtgagagtatattcgtttttagattattcgggatcgggtgtttcggatttgtgtagattatgtatggtttcggttttaggcggttagggcgggataagtacg

SEQ ID NO: 11207 - DNA, 4088 bp, Artificial Sequence
  Description of Artificial Sequence: Synthetic polynucleotide
acgtttcgagtatcgattttatagttacggttatcgtttttcggttttcgtgatatcggcgcgtttgttgtttcgagtaggggaggttttgtatttttatcgtatttttttcgttcgaagatacgaaatttcgttcgggcgtcgtaaataattcgaattcggttttttgatatttatttcggcgggcgcgcgtcgttgggagggcggggtgggtggttggaggtaaggaggcgtatagtaggggtaagcgtcgtcgtcgtatattttgtacgtcgtttagggttatattatttatcgaaaattgggaggtaggtttgggaggcggggttgagcgtttatcgttttgggcgcgttcgcgtttttcgttatcgcggttttcgcgttttcggtttacgttcgcgcggtttcggtatcggtttgtatttttagggtgcgcggcggtttatttgggtgcgttttcggtgggtcgatttttcgcgtttttttttcggtttataggggtcgttgttatgggtcggttttttgaagaggttggggcgttatcggggtcggttagaagttttgtttttcggcggggatatttagtcgcgtcggtatcgcggagcgggttgcgttaggtggttggtcggcgcggcgtttttttgttttttggtttcgggttgcggcgcggcggttggagcgagtttttgtttcggcgcggggcggcggcgggcggtcggtaggcgttgttttgcgtgtgagtgtattttatttatatgtaagtcggggagcgtcggggtttttcgcggaagtgcgagtcgttcggcgtaggtaagagtcgtcgggttcgggataaggtaggggcgttcgggcgtcgttgttttgtttcggggcgttttcgggtattttttaattttttttttttttttttttttattggcgtgtttaagagttaaattaaggagcgtttgagggtaaatagatttttgttattcgcgtttttgtatttttttttttgagttgatattttttggtgttttttggtttttcgttgttgttgggtgttttttggtttgtttttgtttttttttcgtttgtttattttttttggcgttaatttttaggtagttagtttagtagttcgaagttcgggtagtcgcgtttcgcggtttcggggtagcgcggcgggaatcgtagttaagtttttcgatacggggcgtacgggggtcgggtagttcgaggtcgggggtaagtagggagttcgggttaggcgcgagtcgagtttttcgaggtggtcgggttattatgttgaagatggttatgaagtttaaagttcgggcggcggagagcgagaagaagacggtcgcggcggttgtcgaggtggttgtcgaagttgcggcggcggttgcggcgttggtcgagtcgagagagtcgttcgcgtcgcggaagagcggggatttcgagaagttcgcgaagaattttaagaattcggcgcgggaggcgtttttcgaaaagtttttaatagataaggagcgtaagaagttcgagaagaagttgttggagtagaggcgaaaggaggagaagaagaaggagaaggagaggaagaagatggagaagatgttgaagaagaagaagaagaaggtgttagaagtttaggaggaggttcgatgtttcgaggtcgtcgtcgtcgcggtcgtcgtcgacgacgatgagggcgtcgaggagggcgtcgtcgggggcgtcgaggagggcgtcgtcgtcgggggtacgagtagggtttgggttgattgggatacggattcgagcgacgaggacgacgtttattacgcggcgtcgcgcgttgggggtatcgtgtggcggttcgggtcgtttaaggttggcgcgttgagcgtttatttgtttttcgtggtgtttttggttttttcggtgcgtagtttttcgtgggtgtttaattttttgttgtagaagcgtacggagtagggtcgcggttgcggtttcgtgttcggggcgatttgttgttttcgagtgtttttgggttgcgttttttttttttatttgggcggtcgcgttaagcgtagaggtcgcgggcgtttcggggttagaggcgttttcggttcgggttatggcgttcggcgtcgggggcgcgaggagcggtttatttagttagattttttatttcgttatcgttattagatattattatcgttgtgtagtgtgggtttttattcgtgttcgtgtgtgtgtgtggatatattttttttttcggttgttttgttttttggttcgtgttcgtttcgttttttttatatttttgttttttggttttttgtgtttttcgttttttcgaaaatttttttaagttcgggcgcgcgtttttttttttttcgtttattttagtttttcggcggcgttcgcgggagggggaggaggtttcgggggcgtcgggcgacgcggttcggggggtggagcgttggcgtcgtgcgaggggtcgttattggcgcggagacgtttttttttttttttcggtttagtcgggttgttgttcgagttcggggggtggggggcgttttttcggttcgtttcgttttcggtcgggcgcgggcggagggatttttttttcgggttttcggggggtcgttttttttcgtcggttttcgtttttttagtcgtcgtcgtcgtcgcggtcgtttttcggtttttttttttttttttttttttttatttttttcgtcgtcgtcgttttttttttttttcgttttttttcgttcgtcgcggcgtttttggttcggggcggcggcgggggttcggtcgaggtaataagagcggcggcggcggtagcggcggtagtagttttcgtagtttttgttttggttcgtttcggttcggcggcggttattagttttttcggtttcggttcgaggggcggggagttgcgcgcgtttttcggttcgatcgatattttttttttttcgttcgttcgcgcgtttcgcggttcgcggttcgtagttcgtttcgcgcgttttttgtcgaggagtcgagttcgcgttcggttcgttcgttcggcgttgtttcggttttttcggtttgcgtgaggtcgttcgcgttcgtcgtcgtcgtagttcggtcgcgtttcgtcgtcgtcgtcgtcgttatgggttgtttcgggaatagtaagatcgaggattagcgtaacgaggagaaggcgtagcgtgaggttaataaaaagatcgagaagtagttgtagaaggataagtaggtttatcgggttacgtatcgtttgttgttgttgggtaagggcgggcggggggcgtcggtttcggttcgggggttttcgaagggcgtttcgtaggtcgcgcgcgtcgagttcgtttttcgtttcgggcgcgcgttttcgagtttttcgttcgttcgcgggttttgtttgtggggggcgaggtcggaagggggatttaggggcgcggattcggtcgggcgggggtttaaaaacggggcggggggtcgtggcgacgcgggcgcgggtttttttttttcggtttgttcgtttagtgttttttttttgttttcgttttcgtttttttttttttttttttttttttttttttttcgcgaggtttatacgacgttaggggtttgggtgcgtgttggggagggggagggggagtttatggggtttcggagattgcgataaaaagagggtttcggggataggaaatcgggtggcgggtagagggagggggattcgttttcgtggggtgtgagatttgttgggagagggaaagaggggaagaaaggggcgaggagaggagggggtgacgttggggggcgtcgtggtggcggagggggtttcgttaaagggaggttttggcggggagaagtggtcgaggagagtgggggggttggtgatattagtttttcggaaaggatcggagcggtaaaggtggtgtagtgggggggagggggcgtaagggagtcgtggcgtcggagtcgggaggggggcggcgaggggaggagggagggcggttgtcgttgggcgcgatttggtgcgtttcgggtaggatcgattgattgtgtgtgcgcggagtagacgtgtttcgggttaggtcgggtcg

SEQ ID NO: 11208 - DNA, 522 bp, Artificial Sequence
  Description of Artificial Sequence: Synthetic polynucleotide
tcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcgtgtttgtgttaggttttttacgttgtgttttagggttttagtgttcggcgcgtcgggggttgtatcg

SEQ ID NO: 11209 - DNA, 2260 bp, Artificial Sequence
  Description of Artificial Sequence: Synthetic polynucleotide
acgttttcggaaagttttttttaatgggaagcgatttcgtcgttgagttaagcgttcgaattttttttttcgcggtagggatatcggttcgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcggtcgcgtcgcggtaggaggtgtgggaggtagcgaggggaagtcgaggtaaatttggtggcgtgggagattttacggggtttggggaattttagggtaagatcgcgggtttgagggggacgagggggcgcggtttacggagttggggaaaatgacgaagtcgggaaacgagaatatagtgtttcgttttttttcgttttttttgttaaaaaaaaaaaaaaaaaggtgtgggagagcgatagttgggaaggtaggttagatagaaataggtaaaaaaaggtagtgatcggagtcgagtttgttggattttaggggtcgattaggggagggaggtgttcggggacggggagggaggagggttgtcgggatgtgaatcggggaaggtagttggggttggagagtagcgcggaaagggggtttagggagttggaaagagggttaagaggagggtaaggaaggtggcgggcgacggggagaggaaagaaaaagggtgttttggcggtggttttggtaagagaaaggggtaaggggtataattgataaggtattgaaagtattgaagttagagttttgggaaggatttatcgaattttcggcggtttacgcggggatagattttagttcgtgagttttgagttttacgcggggatagattttagttcgtgagttttgagttttacgcggggatagattttagttcgtgagttttgagttttacgcggggatagattttagttcgtgagttttgagttttacgcggggatagattttagttcgtgagttttgagttttacgcggggatagattttagttcgtgagttttgagtttagaaggagtggtagttttaggacgtttgttaggtggtttggaatgtgagggaagttttagtttcgttaggaatagagttggcgttgagttttcggttcggttcgggttagaagcgaggaaagtttgtcggcgagtgttttttgtgttgcgtggagaggggtgtgggcggtcgtcgattcggcgttttttcgtcgttcgtttagggagtttttgtttggtaagttggggttcggggaaaagtttagtagcgagagggtcgcgtgtttcgggacggttttaggggagttcgcgcggaaacgcggattaggcgtttcggttcggatgtcg

SEQ ID NO: 11210 - DNA, 1502 bp, Artificial Sequence
  Description of Artificial Sequence: Synthetic polynucleotide
tcgcgggacggagatagggagttgggaggaaacgtaacgcgttttttaggtaatagatttcgagtttcggttcggaaacgtttcgaggtagaagtaagggtttttaagggtttcgttttttagttttgggtttttattattattttttttttagattcggtgagtttaggttgatggatcgtgtagtttagtttgagttagtttagtagtttttaatcgggcgggtagggaagaaggttttttattgtcgggaagaggttagcgcgttttaagtttttcgtaaatttcgtttttttcgtttggtacggtttttttgtatcgttgtgtttcgtttttaggtttttgttcgttaagaatgtttgtttcgggggcgcgttcgttggttaggaatttgtcggtagttttcgggaatttttgaggatgcggaggtgggttcgagagttgcggtttcgatgtcggggtgggagttaggtaggtcgcgcgtcgtcgtagttttgtcgtagcgcgtgttttggttttttcggatcgaaaaggtcgaagtcgtttttcgcgatcgatttcgcgtaattggttcgggtttgtatttagatggttgtgggttttatagggatggtcgggcgggttcgttcggtcgttattttagggtcgttagttttcgcgcgcggtcgtttttcgttaggaagggtggcgggttcggaaggttagagatgttttagtgtttttcgcgtcgttacgtatttagttgttcgcgggttttatatggttgcggtcggagggttcgtattaggatcgtcgtcgtttggggaagcgtttttttgtgggtagggcgcggcgggtagtgcggaagttcgaaagttatcggagttcggggtaggggcggcgcgatgtagaggcggcgttcgggggtttttagttgtttgcggttcggttatttagtcgcgattagagggggcgggggacgtaggaatttcggcgttcgggcggtgtgtagtcgtagatttattttaagtttttacgtagttgcgagagtttaaaaattgttacgtgtacgtcgttgttgagtgggaggaggtgtttgttatcgcgtttaaaaggggcgtttcggtgtttttcgttatgtaagtaaatggtatggttttcggtcgtttttgaataaacgagtgtttcgaattttttattaggagggattaggcgtataattattttcgatatttttcgggtatgcgagaattcggttttttttagtggggtttattaatgttgttcgggaggtaaagaaagtgatcggttaacggttttagcgtgggttttttttttttttcgtttttttttttaataaaggacgtacggagaataagttttttagtttttatagatgaggagtttaggagtcgggcgaatattaagtatttattgtgtgtttgtttttttattttggggaggttgggggttcgggagtgaagggggtagcgagatcgcgggttgttttacgtttatcgtcg

SEQ ID NO: 11211 - DNA, 510 bp, Artificial Sequence
  Description of Artificial Sequence: Synthetic polynucleotide
gcggtcggttttggaagaggtgggggcgaggggtcgggggtttatacgttttgcgatttttttttatgagaatgggcgggggtagtttcgggaagggtggcggatggagtcgttttttttttaggattataggggcgttttttagtgaaggcgtcgtaggaaacgttagtttgtgtcgtagtgtacgtagaggcgttatgagttcgagttttttacgtttagggataaattgggagtcgtgattgttaggtcgcgcggaggttgttttggtcgtttttgcggttaggtgaaggcgtagaggtagggaggtcgggcgagcgtaggcgggcggagagtagattacgcggaagaggtcgagagagaaagcggggtattcggtcgggggggttatttataagggacgttgggtacgaaggaggttggggcgaagatgagtttaggggttgggttgagagcgttgcgtagtcgggttgagaagagaagttgacgagtgattttcgataagggacg

SEQ ID NO: 11212 - DNA, 940 bp, Artificial Sequence
  Description of Artificial Sequence: Synthetic polynucleotide
tcggggcgtaggtaggaggtattggaagcggaagcgagtggggagttcgggtagagggagtcgtttatttgatcggtttcgtttttttcggggtttgttgtagttgagggtttcggattagcgattttagaagtcggttcggggtcgggtagtttaatagtttttcgcggattttttttcgttggcgcgtagtagcggcgcgtggattcgcgcgcgggttcgggacggcgcgagttcgggtagcgcgagtttttgcgcggtagggagtggcgtatgcgcgggcgttttgcgagttcgttggggcgagtcgagtcgcggcggcgtcgggagtcgggcggcggagttgtgaagaagtaagcggcggtacgggagtagcggcgacggataggtggcgagttttcgttcgcgtcgttaggggttgttgggttattcgcggagtttcgcggtttagacgtggcgggggtggcggcggtatttcggacggtttgtgagggatgcgtcgtttattgtttcgcgtcgtttgatcgttttcgtttcgattcgcggtgcgttatagtcgggttcgcggtcgttttcgtcgcgttgtcgttcggtcgtcgcgttcgcggggtcgcgttcggtacggttatgtggatttttacggaggaggagaaatacggcgtaggtaggtgaggtttaggtttggtcgtggcgggggttttgggggacgcgtttagttttcggtttcgtttggattcgtattttcgtgttttcgttattgttcgtaggttgcgcggtttcggcgtggggcgagcgcggggtgggggtaggtgcgggtgcgggtgcgggtgcgggggtgggcgcgggtttttgtgtagagagggcggtagggggcgttggcggtgcggttttggtaggtgcggttcgcgggaggggtgggtaaggttcgggtagttgttcg

SEQ ID NO: 11213 - DNA, 2718 bp, Artificial Sequence
  Description of Artificial Sequence: Synthetic polynucleotide
tcgtcgttagttatgatttatgttttagtagcgttgggaagtgggtcgagggaattgaggtcggggtgggtgcggaggtggttttgacggggagcgtcgatttaggatttggttcggattttgagttcggtaggatttgtgcgtacgtaggtagcgtcgcgtttttttttaggttgcgagaggttgttttgttattaggttatggatttcgagtcgttcgtgttgcgcgcgcgcgtgtgcgcgttttcgtttgcgtttatgtttgcgtcgggggaggcgaaggaggttttagttttagaaagagtagtttttggaatttattatttaggtcggtcgtcgttcggtttcgtttcgtaggttgtaggcggttttggagggggcgttttcgtcgagcgcgcgtttcgcgtcgtcgtttcggattttttttcggcgtcgcgcgggtaggttcgattaggcggtcgcgggtttcggttttcggttagttttttagggttcgcggttcgtttcgtttcgcgcgttcgtttcgttgcgtaattcgatttaagttggaagtcgatcgtaggcggtcgtattcgcgtttagcgtagggcggcggcggcggcggcggcgtagtttcggcgagcgaggcggcggtcgtacggttaagcgtggatcgcggggggcgttcgcgttcgggagtagtcggaggattcgcggcggcgtcggcgtttcgttcgggaaagtaaagttggagacggagggagcgcgcgggcgcgggggttcggaggagcggcggtcggcgtttcggcgcgtcgagttttagtcggtcggatgggaggcggagcgttcgggtcgtcgtcgtttgtcgtttgcgtttcggttgggtttcgggatcgcggggtcgtttaggtacgttcgttcgggcgtcgcgtcgtcgtgggttcgacgtcggggcgtttttcgtgagtcgggtcgagggcggggtcgcgcgaggatttcgggatttgttttttttttttcgtagtcgcgtcgtcgttcgtttcgggcgttttttgttttgtatttatacgttcggtagttgcggggagttcggtagttacgtttttcggcgcgtcgttcgcggagttattacggtcgagggtcggttgttgggcgtcgcggttttcggcgggcgcgttcgagtagtaggcggcgatgcgggcgtcgatttcggttggggggcgttcgagttgtcgcggttgcgtttcggttttaggagggacggcgtagttcgcgggaggattatggcgttttcggcgttggcggcggcgttggcggtggcggtagcggcgggttttaatgcgagcggcgcgggcgagaggggtagcggcggggttgttaatgtttcgggggttttttgggggtcgtcgcgcggttagtattcggcgggcgcggtggtagggttggttgtcgtggtgggtttttttatcgtttttatcgtggtgggtaacgtgttggtggtgatcgtcgtgttgattagtcgggcgttgcgcgcgttatagaatttttttttggtgtcgttggtttcggtcgatattttggtggttacgttggttatgtttttttcgttggttaacgagtttatggtttattggtatttcgggtaggtgtggtgcggcgtgtatttggcgttcgatgtgttgttttgtatttcgtcgatcgtgtatttgtgtgttattagtttggatcgttattggtcggtgacgtaggtcgtcgagtataatttgaagcgtatattacgtcgcgttaaggttattatcgtggtcgtgtggtttatttcggtcgttatttttttttcgtcgttggtttcgttttatcgttagttcgacggcgtcgtttattcgtagtgcggttttaacgacgagatttggtatattttgtttttttgtatcggtttttttttcgcgttttgttttattatgggtttggtttacgcgcgtatttatcgagtggttaagttgcgtacgcgtacgtttagcgagaagcgcgttttcgtgggtttcgacggtgcgttttcgattatcgaaaacgggttgggcgcggcggtaggcgtaggcgagaacgggtattgcgcgttttcgttcgtcgacgtggagtcggacgagagtagcgtagcggtcgagaggcggcggcgtcggggcgcgttgcggtggggcgggcggcggcgagcgggcgcggaggggggcgcgggcggtgcggacgggtagggggcggggtcgggggcggttgagtcgggggcgttgatcgtttttaggttttcggggttcggtggtcgtttgtcgcgcgttagttcgcgtttcgtcgagttttttttgtcgcgtcggcgtcgggcgcgtagtagcgtgtgtcgtcgtaaggtggtttaggcgcgcgagaagcgttttatttttgtgttggttgtggttatgggcgtgttcgtgttttgttggtttttttttttttttagttatagtttgtacggtatttgtcgcgaggtttgttaggtgttcggttcgttttttaagttttttttttggatcggttattgtaatagttcgtttaattcggttatttatacggtttttaattaggattttcggcgattttttaagtatattttttttcgacggaggagaaggggttttaggtagtgattcgtattcgtttgggaattttggatagtttcgcgttcggggttgggtagaaggggcggttcggacg

SEQ ID NO: 11214 - DNA, 2661 bp, Artificial Sequence
  Description of Artificial Sequence: Synthetic polynucleotide
gcgcggttttgtttcgcgttttttttagttagtatttacgtgtttttatttattttatttaggttattagttttatcgttcgtagcgggttagaagattcgataaagcgttttttattttgtaggattagtgttcggttttcgttgttttttcgttttttttttgcgtagatttaaggtttgattcggttttaaattttaaataaaagttgtgggtttgtttttaagtgatggcggttggagaaaattagagttgggggcggtatagttagggtgtatttttgcggtgggtcggttcggcgtatttatagtttttagttgttagtttaggcgttggggtcgtagggattgaatttcgtatcgttttcgtagttcgggtgcgcgttttatcggtcggtttgtttttcgcggttcggtttatcggtggtagggacggtttcgtttgttttagtttacgttcgttttttttttttttcgtttgtggttttgttcgtttttatttaagtttttggtggtttaacgtatttttgtagagatatttattaagagatagcgtgtgtattttgtttttcgttttacggaagaatttattagtagcgttatttagttttattcgttttaaagtacggtattttttagtttaataaaaagatcgaaggcgaaatattgtgggtttttgttcgcgaattaatcgtttagttatcgaattttttaaattgatttatttggaataagttattttgtttttttattttttattttatatatatatatatatatatatatatatatatatatatatatattgcggatcgggggtttagttacgtatatattttaaaataaacgagggatttattcgggatttttagtcgggcggtcgggcgttttcgttttttttttttttttttgagttttttagggattcgttacgtttttcggaattggggtagcggttcgtttatttcgtgttcgttgttggtcgggatgattttagattcgtttattaaggaagatttgatgttagttaaatcgttttttttttcgggatgattgatttcggcgaagattttttttttttgaggatcgttttcgtttttgaaggggattatttcgttcgtggcgtagagtttcgggtttttttcgtcgtcgttatttttttcggagagttggggtatttcggcggttttgtaattttcgtttcgttgtgggagtattcgcgtaatagtaggaaagatagaggggtaatttaagggtgggggaggaaaggagagttggaagggttcgtgtagtaggatagcgggcggaagcggggcgggcgagcgcggggtcgtcggtcggtagtcggagtagttgtcgcggcgttcgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcgttttgtttcgtaggtgagcggttgcgtttttttattgtttttttttttttcgcgtttcgtcggcgttgaaaagttatttatttgcgtcgtttttttttttttttttttttttcgtttttagttttttttggttgttcgttggaggggaggcggggggtgagggggagtcggcgagaaggaggtggtgattgagggtttttttttttttttttttttttagattttgtaggacgagttttggttttggggtgtgtgagtgtggtgtgtgcgcgcgcgtttggagggaaggattaggtaatttggcgagagaaggaaggatcgggcgttgtttataatttatcgaaaggtacgttttgttcgcg

SEQ ID NO: 11215 - DNA, 801 bp, Artificial Sequence
  Description of Artificial Sequence: Synthetic polynucleotide
gcgaggaaaattgacgttttattttttcggattttgttcgagaagttgggggattcgggttcggtgtcgaggtgtggttcgagtttggtattatttacgtcggtcgggtgatttcggttttttggggttttcgcgtttcgttagtaggcgacgttgggaggttggggtaggtttagagcgaggacgggttcggattgggtagtggggatgtattagggtcgggtgcggcgggagacggttcgggaggcggaaggtcgcggatttgttcgatagaagagtagatgaggggagatcgaggacgttcgggttcggggagtttacgaggaggttaggatcgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcgttcgggttttttaagttgttagtcgcgttcgttttcgggtttttcgttttttttttcgcgcgtttttttttttagcggtcgtcggatttttttagtttattttttttagttaacgcgtttttcggacgttgttagtttgagcgtataggtattgggcggggtttacgggggagtcgtttaataatcg

SEQ ID NO: 11216 - DNA, 311 bp, Artificial Sequence
  Description of Artificial Sequence: Synthetic polynucleotide
tcggttttcgtttcggtggttttaggtttcgggttttgtttggcggttttgtttttaatgcggagttggcggttttgtagtaacgtttttgttagtagcgtttattgagcggttttttagttgttgtatcgtttttagcgtttaacggaacgtttttcgtacgcggagtttataagttgtttgtgtcgttattttttcggttttggtatcgttagtattttttaggaattttttaaattcgttttacggtgtagaacggtaattgtatcgagtttttgtgttaattagtattttcgtaatatcgttagtcg

SEQ ID NO: 11217 - DNA, 1048 bp, Artificial Sequence
  Description of Artificial Sequence: Synthetic polynucleotide
acgggagtaggtcgggttgtttacgacggaagtttcgattttggttggggttgtcggtcgggtagcgcgggagagttagggttagagtcggggtcgggaattttagtttcgtcgtttacgcgggatgtagcgattatcgttcgtcgttttcgggtcggtatttattttcgtggaggggtagcggcgttagtatttggtcgcggatttcggttttgggggagttaagttcgtagcgttcgcggtcgatgcgaaacgtgagcggggcgtcgcggtcgggtttttgtatcgttacgttgatgagcgtcgtgtagtatttttggttcgcgttgtttgttcgtgtcggttataggttgtaggttagtagggcgagcgcggcgagtcgggtagggttcgttcgtttcgcgtagtttatcgttttttcggtagtcgtcgttgttcgcggatcgggtttcggggtcggcgtttagaggcggggcgggcgcggttcgggcggcggcgggagcgcgcgcgcgcggtttgcgcggggtcgagttcgagcgcggtttttttggacgtcgcggtttcgtcgttcgtcgtttttacgtttattgttcgtttgtggggacgcgtttatgggttttcggcgagggcggcgttttaggtcgtacgcgggcgttttttcggggttttaggagggttgtagaagcgtgttttttttattttttcgggtcggttttatcgaatgggaggcgtttcgtaaggacgcggcgggggaggggaagggcggtacgggaggaagcgtttcgaggagggttagcggaatataaagtttttttcgcgcggttgtcgtttgaggcgcgtgttcgtcgtcgtttcgttttttcgttggtttagcggtaacgcgtaggtttaaggcgtagtttcgtttcgagcgtatgcgtgttagggtttgttcgttttcgttcgtttgtacgagggttcgggtagtcgggttagtcgttggtgttggttgtttttttgttaggcgtgatagtcgtagggcgtggagttcgggagatttgcgaggacg

SEQ ID NO: 11218 - DNA, 301 bp, Artificial Sequence
  Description of Artificial Sequence: Synthetic polynucleotide
gcgaaattcgttttcgtttcgaagaagggttttaagaaggtcgtgattaaggcgtagaagaaggacggtaagaagcgtaagcgtagtcgtaaggagagttatttcgtatacgtgtataaggtgttgaaataggtttatttcgatatcggtattttttttaaagttatggggattatgaatttttttgttaacgatattttcgagcgtatcgtcggcgaggtttttcgtttggcgtattataataagcgttcgattattatttttagggagatttagacggtcgtgcgtttgttgtttttcg

SEQ ID NO: 11219 - DNA, 1395 bp, Artificial Sequence
  Description of Artificial Sequence: Synthetic polynucleotide
gcgaatcgatttgtatttttttgtttattaggaagcggtcgtcgtcgtcgtaattgttggcgttgatcgcgtacgattggaaagttgtaattttatggttcgaggggtaggttcgggttgagtaggttttcgagtcgttattgttaagtatggggtattttaggaaggagtttatttttgtattgtttatttgttattgagtgatttggttttgcgaagttcggcgtgattgtgttaatttttttattttttttatggggtcggagaagaaaaatgatatgaatgtatagtgcgtaagagggggggcgggagggcggaggacgttggaggaggggtacgtgacggtgttagttaatggttgagttttttgtaaaagtttgtcggttttcgtagtgatggattatcgttttagtggtatttaaattttcggcgtttcgtcgtttaggtgacgcgtagtcgtttttttaggtagtttaggcggcggtagttgttgcggcgattgtaaaggtcgatttggagtgttggagcgaagaagagtaaaagttgcgttttgcgcgcgttcgatttcgttgttcgtttcgttaggttttcgggaggtgggggttgggaggcgtttttcgttttcgttttttttttatcgtttaatgaaagatgaattggcgagaggtgagaagggaagagggttttcggttttttcggggcgggaattagtgggttagagttcgtcgggtggtcgtaagtacgtcggtttagttcgtagcgcgtttagtcggaaggcggggaattcggttgatatcgcgtttcgggtttttaggttattttttttgttttgaggttgggttgggagatcgtggggttgtgaggagcgtatagaatcgtggtggagggcgaggttgggttatcggttttttaagttcggaatggagggggaagagcgtagagggttggttgggaggaattcgggtgggcgtgaaggagacgagggtaagaaaagaaatttttttttttttaggagggttttcgaaattttttttttatagtttttttcgttattagtatggtaatgaggagtttttgtaattcgatttggaggggcggatgagttttggaaatttagagttcgtcggaaaaggtcgggggcggtcgggttttttttttttattttttttttttcgtcgtttttcgttttttttttttttttatttagttttgtatcgggagtttttcgggatgcggagttattcgatcgtcggatttttaggggtaggaggcgggggagagagatgacgttggcggacgtggttagcgcgggggtcgggcggtgcgttgtaggttatttgtcggcgttttgagatttaggagttttcgcgttttcgcgtgggttttatagggtcg

SEQ ID NO: 11220 - DNA, 766 bp, Artificial Sequence
  Description of Artificial Sequence: Synthetic polynucleotide
tcgggtttttttcgttgtggttcgtttgtatttttgagttggtatttgtttttcgggcggttagacgttcgtttggtttttttttcggtttcggtttttttttcgcggcgttttaatggttttcgtttttcgcgtagggttacgattgtttttcggtgttgtttatttatgacgtcgtcgcggggatgttgagtttcggcgggcggttggacgtttttaagtagagttcgtagcgtggtttgacggttcgcgagcgtttttagaatttggataagaaggcgagtttcgagggtggtacggttgcgggcgcgggtttagattcgttgtataagaatagcgttaggtgagagcgggagtcgggtcggcgggtgggcggggtttcggttcgtttagaaatagcgtcgggtgaggaaggggtttggagttttttttttggggtattgtgttgggattttgaggattggggattcggagggagggtaggcgtgtttttaattcgttgcgtcggaacggcgtttgatgagcggcgggttcggatacgaggggacggggtcgatttgtgggcggggttttggcgtcgtattaaaatcgcgtggggcggaggtcggtagaggtcgcgtagcgggtttagggtagggagtggttttgattcgttgcggaataatatcgttagttgtgggcggggtttattttgattttattatagtagtttaggtgttagtggagtttgggagggatacggtgcgatcgatataagacggggtcg

SEQ ID NO: 11221 - DNA, 691 bp, Artificial Sequence
  Description of Artificial Sequence: Synthetic polynucleotide
gcggtaaagaggtcggatacggaatcgttcgttcggtgatcgaagagacggcgaggaggagttcgcgaattcgtttttgtttaggtttcgtttattcgacgtaatttgttcgtttttttttatttttcgaagggtggagtttgaggtttcgtttttaagcggttttttttcggagtgtttggcggttagtagggcggggtaggaggttgggagagggacgggtgcgggggtgggggagaggaagggagcggttacgtgtgaggggcggttcgaggttacgtgacggagcgtcggagcggagggagtcggggttgggagtttttttgagggaagaggagtggagtaggggggacgcggcggcggcgttgataatggtgagtgcgcggcggttagcgcgttcgtttttcgttttcgtttcggagcgcgcggcgggtcggttaatcgcgggtcgggcgtcgtcggaggaggggacgggggagtagggcggggagcggggttaggtttgtcgggttatttttgggtttgggaaaagttggcggcgttattttttttcggtttcggcgaggttcgagtatttacgggcggcggcgtgtttttttggttatgtcggagtttttgttcgcgtttttcgattgtttgttggggttttggttggggattcggatttcgtttttgcgggggttggtcgtcg

SEQ ID NO: 11222 - DNA, 1024 bp, Artificial Sequence
  Description of Artificial Sequence: Synthetic polynucleotide
tcgggagggcgtagcgttcgggtggggagttcgagttagtttaggtcggttttggttttttgatttagatagcgtagggcgcgagggatcgcgcggtcgagttcgggtcgcgtcgtttttagtatcggggtcgttagttaagagttcgaggttttttcgattcggatgtgatgaaaaagagtaatagagggagaagtgttttaggattgtaggagtggaagaggggaaagagaggtagagagggggaaggttttttcgtaggggagtcggttggagtgagttggttggaaagagggggcggagtgcgcggagttagagtcgttatcgttgtcgtagttgtcgttattgcggcgtttgggttgagtcggagggaggcgggaggacgcgtaggggcggtcgtcgtcgtcgttaggttatcggggcgaaaatgcggtcgttgtcggaggttcgttaatttttcggggtggaagaggaggaggaggaggaggaaggggtttggagcgattacggggggatgcggaggtaggtagtggttttcgggcggggaagaggaggggtttgatttttattttcggggtttttttaaattcgatttttttttttagttttttttcgttgggtttatttcggatttttgggatttcgtcgttgttaatttgcgttgtaatagtttttttcgtaagttttaaattaaaattttttcggggtggagtttgagggagggaagtggagggggagggaacgtttcgtaggggtggtgtgtttttttttaaaaatatttttttttttaattttgtatattttttcgttagaagtagttagttttttgtatttagtattttatagtttttttttcgtgcgttttgtcgggcggcgagttaggcggtagcggcgcggcgcgggttcggcggagcggtttatgttcggcgcgggcgaagttttcgttttcgggttcgtggggtcgtagcgcgtggtcgaggcgggcggcggttagttgggttttatagtttagggtgagtgcgcg

SEQ ID NO: 11223 - DNA, 1339 bp, Artificial Sequence
  Description of Artificial Sequence: Synthetic polynucleotide
tcgtttttagcgtttttaggtttatttttcgtagatttttttcgggtcgtttttttttgttttattttaggcgttttttttttttcgtagttatatcgtggttgtattcgtcgttttttttttcggtcgttattatttcggttttttagaattttagtttttcgcgttcgtagtcgcgtttttgttttttcgattttcgtatttttatttggttcggttttttcgtttttttttcggtttttttttttaggatatttgtgtcgttttattttttttattatatacgtattttttattttaattttttcgtttttttgttttttttttttcgtcggtttttttttttcgttgttgtttcgagagttcgatgtgggagggaaggcgcgggggaggggaggtcgcgaagggggttgttttttttcgggtttttcgtgttgcggaattgtagggttttttagcgttttttgtttttttcgtcggcggcgcggaagtcggggtttttcggacgttttcgatgagggtatttatttttttgtcggggatattttgtagacggttttaatattggtaaatattatagagaattgatttcgttcggtcgtcgtcggtttttatttttcgggtttttcgtttttcgttttcgttcgttttcgttcgttttttcggcgttttcgtcgcgttttttcgcgttcgcgtcgcgcgttttcgtttgcgtagtcgttttcgcgttttagtacgttcggtcggcgcgcgcgttcggtatcggttttatttttatttcgtttttcgttggttcgcgattaagcgcggttattgttcgcgacgtagttttcgttttttggcggttgtcgggttttagtagttgtaggttttgcggggttagcggcggcgagttgggtttttgggcgagggttattttcggggggtttgggtacgcgggcgagcgattgcgtaaggagcgcgttcggttcgtagttttttcgttttcggcgcgatttttcgttttttcgtttgttaagggtgggtttggggtagttttttttatatttgtaattcggtaattttttttttcgttcgattgatcgtttgttttttttggttcgtattttgtgttttgatttttcgttcgtattttttttaggtttttcggttgtttttttgtgttgtgtaggggacgcgcgattatttcgcgtttgtttcggtcgtcgttgtgtaacgtacggtttagcggattttgtatttttttagacgggggagggggcggggaggaggttgttttatcgtttcgtttagtaaatattagggattcgtgattatttgttcgttaagattcgcggcg

SEQ ID NO: 11224 - DNA, 2273 bp, Artificial Sequence
  Description of Artificial Sequence: Synthetic polynucleotide
acgcggtggtattggtggttgtcggtagttgtcgtttgtagagtgggtgagatcgagtgtggtagatggtttggttcgcggtgttggaggggattggcggagtagaagcgttttggcgtcgggtttttgtttttttggagttggggtttggggaatggggtcggttattgtagggatagaggagagggtagggtaatgggtgcgtaggggttttttttaaaggttgcgggtggttaggggtgtgcgggggcgttgaggtgcggtcgtcgagagattttggtttttagggtggtcgggtttggtatggattttaggggatggtgtatatatcggatcggacgggttttttttttattttcggatttttcggttgggtagcggttagggagaggggcgatttacgggggcgggtgtggggacgtcggattacgcgttaggagttttagatgggtttagatttttatttttcgtttcgggtcgtagtgacgttagggttcggacgttttcggaacggttttttgggggcgttttagttttacggattcgtagggagttttcgtcgtaatttgtatggggtttatttgtatgatttcgtttcgcgcgggagtcgggggcgtcggcgattggaggagttattgttaatttttaggggaaagtgggcgaggcgatttttgggtcgtttattttattttattttttagttcgcgtcgtatttggggtttttttttatttacgtttcgttagggcggggtcgcgggcgtagatattcgcgggtatacgtacgacgacgcgtatacgcggtcgtacgcggtttttcgagttttttgcggcgatttcgatttattttcgcgggtgcggggcgcggattcgttcggtttagtttttgttttttaggcgtttttttttttcgcgatttgtttcggtcgtattcgttttcgttttagtacgcgacgttgttcggcgcgatttttgttttttcggtttagttttatcgttgttttcgatttaattttagttgaacgttcgtagttttagttttattttcggtttagttttagcgtttttagttttattttcggttttagttttagttttagcgtttttaggtttagttttagttttatttttagttttaatatttttaggtttattttcggttttagttttagttattttagttttagtttcggtttagttttagttttagcgttttcggtttcgggtttagttttagttttagttttagttgagtattttcggtttcgtttgttcggcgtttttttttgtgcggcgttttttcgttcgtattcgttcgattttttggaatttttcgcggacgtcggggtttttggaggcggttttttttgtttttgttttcgtttttttttcgcggcgttttcgttttttatttatttttttagtttcgcggggacgaggggagttggagggagttcgggattcggcgcggttttcgtaggcggcgtttttttttcgttttcgacgcggtcgttttttttgtttgttcgtttttatcgtcgttttcgtttttgtcggggacggggatagtagattttcggcgttcggttttcgcgtatttgtcgcgcgtatcgttttttcggtttgcgcggtttcgggggtttcgggaagatcgagcgttggcggttagttcggggaggttgtgggtagtaggggtggttgcgggtttttagtttttttttcgtttatttcggagtttatatttgggatttttatttcgggagaattttgttttttttttacgatgagtttggaggattggagtcgggatttggtatttttagggttgtgattgggtgaattttgagggtatagttgttgttcgtcgttttaggggttttaggatggggcgagtagttttgaagaggtttaagggtatttcgtgaggagtttttacgttttgagagtggggcgtagagtcggagtttcgggttatgttttcgttgtcgttggcgcgggatattcggtagtcgtttggcgtttttttgttggtgcgaggttttatggtgttttgtaacgtttgtttgattttgttggttatcgttacgttcggtttcgcggtgttgttgttttttaataattgtaggtggtcgcgggcggggcgtcgtattggttaagttttaatttcgaggtttttgtatatagaggttggaggtcgcggcgggttcgcggggttttcggtagtttttcggggatgggatgggttattttgcggatttttcggtttttggaggtcg

SEQ ID NO: 11225 - DNA, 5586 bp, Artificial Sequence
  Description of Artificial Sequence: Synthetic polynucleotide
gcgtcggttgttggggttgttaggtgttaggagacgtttttttcgggtttgtttcggcgttcgtttttatcggcgtttgttttgtcgtttagttataggtttcgggttttttcggtagcgcggagttgacggtgggcgcggcggtcgtttgttttttggcgttggagggcgtcgacgtgagttatattaattatcgcggtcggagttcgttggatttggtcgtcgagggtcgcgtgtttaaggttttttagggttgcgtttagcgttttcggtgagttcgtggacggcggggatggggttcggcggttttcgggttttttttaagtcgttttttttttttgtagggagcggtaggcgggcgggggcgcggtttcgggttttaggtaaacgttcgggatttttaatatcgtgacgaatttgtacgtgggcgtcgcgtcggggttcgaggtcgttgagtgtttggtgtgtttcgagttggcgttgttggtgttgttttcgtcgtgttagtatcgtatcgtgtgtgagggtgagtggggggtttcggggtggggaggttcggttagtagggtcgtagttaatcgcgttttttttttcgtagagtgcgcgcgtaggatgaagaagtgtattaggtgttaggtggtcgttagtaagaaattgcgtttaggtgggtgaggttttgcgtttttaatacgttttttgtttagttggtggttcgcgggttttcgttttttatttttttttttttatattttcgtttatggtttttttttaggttatatttcgtttttttaaggtttatattcggttttttagtttttagtttttagttttgtttgttttagattatattcggtttatagtttcgttttaaggtaatattttttttttttattatattttagtttcgttggattttacggttttttttagattatattttttttatagttttattttagattatagtttatttagagtatcgtttttttattatatttcggtttagtttatagtttatttgtagttttgattttagttcgtatattattttatgtttgatttttacggtttattttttgttcgtattcgggttttatttttgtttttaaattatttatttcgttagttttttttgtaggttataattcgttttaggtgatatttcgtttttagtttcgttttttcgtagttttttgtttttcgtatttttttattcggttttttagtttatattcgttttttatttcgtagacggttttgaggtggcgagcgtcgttttcgttttcggttcgtcgcgttagttggtggaggagttgtagagtcgttatcggtagatggaggaacgtattatttgttttatttgtatcgatagttatattcgtttcgtgttttagtgcggttacggcgtatgcgttttttgcggtttcgcgtttagcgtttgttttatttgtcgttagtttattcgcgatcgtatttagattttcgtgtgagtcgcgtcgttcgtcgcgttcgagttgttttcgcgtgttttcgttttgtgttttataaaaagaaagattttcggacgttgtttttgttgtttgtttgggggatcgggcgtttttggggtttttttttcgggatacgcgggcgagtttgggggcgaggagggggggtttttttttgggttcgtttcgttcgttttaggttttcgggtttagattttcgttcggattgcggttttcgggttaggatattttttaggcgcgggtacggtcgtttttcgttttttaggttcgggttcgacggggcggggatttttgtgtttgttttcgggtttttttcgttttttcgttttgggggcggtcgcggggattcgcgttttgatttaaggggttcgatattttttagggttgtggggtttcgttttagtagggagttagttggggggcgttttaggtagggtttgggggtcgggcgtacgtaggcggggtgacgagttgggggggcggggggcggtgtcggagtaaatacggcggttaggtttagtttttcgcgttttttaagaatcgttcgcggtcgtcgttagttgtttggcgttgatttcgttggtcgggttgtcgttattttgggttcgacgtcggcgcggaaaacggggagggacgagatagatataggtcggtttggttcggaattttttgtttttttgtttaattttttattttcgtttcgcgggacgtcggtgttcggtttcggttttagtttagagtcgttcgcgtttggacgtcggtcgtttcgtcgaatttttgggttttcgagtttttcgttttcgtttttaattaggatcggtttagatttttaggttcggcgtttagtttcgtttttcgtttttttcgttttttttttttttttgttggggtttagtcggggatttaggagttatatattttttattttacgcgttattttttacggggtttttcgtagttagggttcgttttttttcggtttttcgggagattttggtaagtttttttttttcgtttcgtaatttggtatttttcgcggtttttgtttatttacgtatttttttttcgtttttttttttatcgttttatatttattgttacgtttttattcggttatttttttttagttttcggggatattgttaggcgagcgacgcgttttttgcggtttagtttagttgtttgggttaggatggagatttcgtttatgtggggtttaggggttttttgaggattttatttgggaaaaaagttattagattatttattgtttagtagtgggggtttggggatttttattgttatttttttttaagcgggagttttggcgttgtttttttcgggttgtttggggtttttttcgttttttttttcgaggatttcgtttagtaggttatgtttaggtttttgtttttggtttacgggacgcgggtttttatgttttcggttggagatagtaggtagttcggttaacggacgggttagttggttttttttaggggtagttttgttttttttttcgtttcgttttttttttttttattatatcgggttgtaattcgagtcgtcgagttattgtttttttttcggatttttttcggaggttttgcggttcgggttttcgcgttttgttgttttatgtagttttgagttttatagtaagtttgttatgggtcgcggggttcgtgttttttcggaggtttcgggggtaggcgtcgagcgtcgttggtttggagtcgcgttggtcgttttgtgtttttttttcgcgttggtgttgttggttcggttgggggtttcggcggtgtcggtttggagcgtagcgtaggtgagcggcgggggggaggttaggtgtcgggttgggggggtttttacgtttgtgggtttggtttatcggggggttcgtaggacgtgtgcggggtgtgcggggtgtttgagggttcggatgtgcgtttcgaggtcggagggttggacgtttttgtgtttagttgttgggaggggtgggaggtttcgttttgttgtttagtttttttttttttattgggtcgcgtttttagggacgtgtaatagggcgtttaggttaggagattcgaaattataggtagataggattcgttacgttcgtttttagttttgggtatttttattttcgtttttttttagtttatttttcgcggtagtttttggttttggggatcgttatcgatgttttttacgtacgtttttttttttgaagggagacgtcgttgcgttgggtttttcggcggttttttttattcgggtttcgggtttattggtttttcgtagacgtcgttatacgttgattttagttaggttgcgttgggattattttaattttatttataggtgcgttttggttgggtttcgggggagggggcgcggtcggcgttcgttgagtttattttttttgtaggattttttttttttcgcggaatttgttgagttcgcgggagacgcggcgggttttagttgtcgtttttcgtatgtggagcgacgtgtttttttttagttttcgcgaggtggttttcgagtagtttagcgattttcggataggtgggcgttcgttttcgtttcggttcggttttgcgcgttcggttttttagtttcgtgttttttttaggtttttattcgattaattatacggattgtttggttttcgcgttgtattattgtttcgacggttttacgggggagttggtttacgttttttttttttcgtacggcggtatttatttcgacgatagcgagtattgggttttgggttttacgcgttatagttggaagaaaggtgatcgtttaggttggttttttggaggttttttttttgtagtatagtgggttgtcgcggtcgggttttggggtagacggtaggagggatttttcggggtggtggttgttattggagtttagtaggtaaggaggggagttcgtgggagtttttatttcggtagttttgaatttttttttttatttttttgcgtttttggagcgggagttggagttgtatttttgggggtcgagtttatcgtttgggtttagaatatttttattttttcgtggttgcggtcgagggcggtttcgcggttgcgttttagtagatatatcgggtttcggggagttggtttacgggcggcggggttgggttcggggtttttaggcgttgattttcggggttcgtaggcgtgtggtttacggatttggtgtacgtggcggtttacgagatcggttacgcgttgggtttgatgtatttataatacggtcgggcgtttatgtatttgaacgttacgttgcgcggttggaaggcgttgttttaggacgagttgtgggggttgtatcggttttacggtgagtttttttgtcgggcgggagggcggggatcgggcggttttgagttaggtcgtgttttttacgttttcgataggatgtttcgataggttgttcgtgtgcgcgttttgggcgcggaggggtttttgcgacgttcgtcggcggtttatgaagaggttttgttttagtagttgcgatttttgttacggtgatgtttacggggtcgggatagggttgcgtgggagttgggttttggttatggtcggggttgagggggtattgacggggtttttttttttattcggagtagaattttttttttttacggtggttattattttatcgttttttaggattaaaattaggttggtgttcgagggtaggaacgtgatttttcgttgcggttagaagattttttataagaaagggaaagtgtagtgagtgagcgtttcgggcggttttcggggtgggtagttcgcgggcggttttggggtaggggtgcggggtaggtagcggggggggttgtgtttgtaggagacgtttcgtttttttgtagttggtataaggattaggagtttttggagtttttttatttcggttatttggttttgggcgaggcgtatttgagtattatcgttaacgtcgttaatgagggtatttatatttgcgtggtgcgtcgttagtagcgcgtgttgattatttatttttggcgagttcgtgtgcggggttgagttcg

SEQ ID NO: 11226 - DNA, 1264 bp, Artificial Sequence
  Description of Artificial Sequence: Synthetic polynucleotide
gcgcggttcgggcgtagtttcggcgtagttttcgcgtcgagcggtttcgcgtttcgtattagtttttgttcggtttcgggtgacgtcgtatttttcgattggattacgcggtttggggggcggggtttggttcggtgagtttatcgtcgcgtttcgttattggttcgggcggcgtattcgggtagtggcggggagatcgcggtattcggagtttcgcgagtcgttttagttgcggcgagtggagttgagcgggcgcggggtcgggttgggtcgggtcgggcggggtcgggcggggcgcgggagttagtgagcggcggttcggcgtaagtttgacgagtaggagtcgagtttagtaggttcgggtaggtgcgcggcggcgcggggttaggcggagggcgcgtgcggtcgagggcggcggttggcgggggcgcgcgcggggcgggggcggggtcggggcgtggggatacgcgtgttcgcgggtcgggggcgtggtgcgcggttacgcgtgtttttggcgcgagtgtgcggggttaggtcgggagggcgtgcgcggatcgggcgtgtttacgcgcggtagggaggggttacgagggtgcgcgcgtttttggcgcgagtgggaagtgtggggattcggcgggttcggtgtgaggggcgtgtttttggggcgagagtggggagtgagtgtgaggagtaagggtgaggggttgtagggaggggtgcgtttggtcgaggagtgggtgggagatacgcgtgtttatgtcgcgagggtgtgtcgacgttcgagtttgcgtggggttcggggtcgtgtgtttggagtggtcgagggcgtgaggggcgcgcgtgtttgtgcgaggggcgtgtgcggcgggtgtgagttacgcgtgtttgggtgcgcgcgcgggtcggatgagtttttggagtggtgcgaggacgcgcgcgtgtgtttgtgttggagcgagggcggggacgagcgtgtcgggcgcgcgcgggcggggttggggcggcgtcggggcgcgcgggggttcggttcggtcggcggcgagtgtgttggggcgttcggtttttttttaatacgggtttttgggatttagtgtcgtttttttttcgcggcggggttcgcggagttttcggtttttttgggtagataggtgcgaggcgaggtgcgggtatagttttgcgttttttagcgggtgcgggatcgggcgacgggggattgtttttaattatagattaggggagcggagggacgttcgatttattcgcg

SEQ ID NO: 11227 - DNA, 716 bp, Artificial Sequence
  Description of Artificial Sequence: Synthetic polynucleotide
tcgttttcgcggggcgggaatttcgcgtttttttttttcgagttttattttttatggtaaagcggcgtggggcggcggggcggagggagtcgagggggcggggagggcggacgggcggaggggacgggaggtttagcggtttcgggtttcgttggttcgggcgtcggatcggagtcgtcggggcgcgggcggtttaggtaagcgggtcgggtgggtgggggtcgcgttttttcgtttttgttttcggtgtatataggtgatagcgtcggtagtgttcggtcggagtttgttcggtcgttagtcgggattttcggcgcggcgtttttggaggggtttgcgggtggggggtgcggtttttacgttttttgcgttttagttttttggttttttttttcggagtcggggagtcggtaggttcggggcgagggtttagtgaggtcggcggagggtcgagttttagttcgggagcgggagtcggggattcggcgcgtagggcggaagttttcgtataaaaggtcggagtttcgtatatggatcgaattaaagtttcggcggcgtttagcggtgatttcggcggtcgttttgttcggttgtttgcggagggtttcgcgttttcggagttcgggggcgttttaggtttttttttttagttagggttaggtaaggggagggacgggtttcggggttgtttttttttgggttttacgcgttcgtcg

SEQ ID NO: 11228 - DNA, 619 bp, Artificial Sequence
  Description of Artificial Sequence: Synthetic polynucleotide
tcgttcgggattcggggggaggcgcgttgggtggttcggtagtcgggggcgggcggtagtttgtaggcgtaattggtatgtacgtcgttgtagttgagatcgtttaataaagtattatatattttatcgtttttatattttattattttacgcggagtttgtgagagggttttaatgggagttagttgtgtttttattttttgttgtcggtcgggacgggtttttttgcggattttttgaaatgaaataatgtgatgtacgtcgcgataagggtcggtttgtaatgaggtttaggtcgtcgggcggttgttattgttttaggtgtcgcgtatttgggttgcgaggataaggaggaggagggggcggcgtcggaggatcgggggggagggggaagtcgcgaggggtagggggtgggagaaggcggagggaggaggtagggggtagggggcgggcggaagaggggaggaaggagggggcggcgggtcgcggtaggttaggcgggagaagtcggagatagagagaggacggggatagtggcggtttgtagagttttaggaattcgggtttaaattttgttcgttagcgtgagagagcgtttgttcgtttaggcggtttatcg

SEQ ID NO: 11229 - DNA, 293 bp, Artificial Sequence
  Description of Artificial Sequence: Synthetic polynucleotide
gcggtttcggtaggggttgttgcggcgatttaggttgttgcggttttagttttattagttgttgttgttttttaaggagacgtcgtcgatagcggagtagtggttgttgttgttgcgggggcggtagttagaggttttagcgttttaataatcggagtttaggatgttgtttcggttgttgagaggttcgtaatttttagcgttgcgttagagaaattcgtttagtttagagcgggttcgtttcgttgcggtttttacgcggggttgggtttcggagtttgtttcgtaaagcg

SEQ ID NO: 11230 - DNA, 2748 bp, Artificial Sequence
  Description of Artificial Sequence: Synthetic polynucleotide
acggtagggggttttcgtgtttttcgagaatttaagaattcgtttcgtttttacgcggaaagttgggagaaaaattgttttttttttatttttttttattttttatttattcgtttttggagtttcgttcgtagatatttttttttttcgagttagaaatagatatattattttttttttattttttttttcgtgcgtatattcgtttttttttttttgtttgtttttcgtttttttttttttttttttttttgttcggagttgtagtttgtagtttcgattcgggttggttggttggttgagtgcggtcggggcgttgttcggtagtgcggtgtttacgggattgataggtaggtaggtcgcgggttgggattcggatattaaagtaaaagtatcgttgggcgtcggaggagtcgcggggtttttattttttttttgattgatttttaaattttaatttgtatttttttcgtcgtttcgttttttttttttcgatttcgttttatcgtttttcggtttttttgtttttttttttttttcggttttttttttcgcgttttttttttttgcgttttcggtttgttttttttttttttttttcgtttttttttttttttttttttttttttttcggtttttttcgttttttttttttttttttttttttttcgttttttttttttgcgttttcgttttttgtttttttttttcgtgtttgtagacgcgcggatcgtttatgcgtttttcgcgggtagaatgttgggtagtagcgttaagagcgtgtagttcgaggtggagttgagtagcggcggcggcgacgagggcgcggacgaatcgcggggcgtcggtaggaaggcggtagcggcggacggtagaggtatgttgtttaagcgcgttaaggcgttcggcggcggcggcggtatggttaaggttagcgcggttgagttgaaggtttttaagttcggtagcgtggatagtcgtgttttcggcgggtcgttcgtttttaatttgcgtaagtagaagttatttattaatttttttttttttacggatttcgagaaaaagttgtagttttatgagttcgaatggagcgacgatatggttaaggcgtttaaaggtttaggtaaggtggggtttaagggtcgtgaagtttcgttgatgtttaagacgttgtttaagtcggagtattcgtttttttaggttaagggtagttcggcgggcggcgttaagatttttttggtttcgttcgcgtttaatttgggaaagtcgagtcggatttttcgaggattttatgcggaggttaagtcgtttagtaaggcgtttgaagcggtcgtgagcgaagatggtaaatcggacgacgagttgttttttagtaaggttaaggcgtaaaagagttttgggtttgttttttttgttaagggttaggaggagcgcgttttttttaaggtggatttcgagttggtggtgatcgtgttgggagatttggagtagttgttttttagttagatgttgggtaagttttgtcgtttcgtttcgtttcgtttttggtttttttttaattagttgttggggaaggtgtggggaaagcgaagttttttttttttgcgttttttcggagggtttttttgtttacgattaggttgtgatgggtattgcgtttagatgtgttgagttggtttatttttagatgcgtatggtttaagtgtatttttttaaagatattataggcgggaattcgggttcgattttggtttgttcgaggtgaggttggataatgggatggggggtgagggggttataggtttttagaaatagagttagaattttaatatggtaaaatttgggattggtggaaattttcgttgtggtgtggtttgcgtttgataggagtatttcgtattgtaaggggagcgtttagcgagagttcggatttagaggatagatgtgggagagtagatgtgagggttgattggtttcggaatatagttgaggttttattttttttgtggatttcgagtgggagcgtaagtcggattttttcgcggtgtgaggattttggttaaaagaagcgtttagggtcgggggcgggcgggttgttagttgtgcgtatttgggcgtatgttcgatattttagtttcggttttggttttaatttttatattcgtaggttttttagggcgtgtcgaaagttttgggcgttagcgtcgagatttttgtttgatcgggaagtttttgttttgtggttaatggaagtcgagtaggcgggaagggaggaataaagtttgttcgagtggaggaagcgcgtagagttgttttattgtttttcgtgtttgaagagtttatgtaaaaaaattcgaagcgggtttcggaattgtttttttttttttcggagagtttttgtttttagagaggaatagatttgggatgtgtcggacgttaggcggttatgtttcgggaattggtacgggtttttttggggttacggaataaggacggtggggtttggtgtttaggcgagttgttttggttgcgcggatttgttgcggtggttgggttgtgggtttttcggcgtcgagggattcgagttttttgggtattcggtaggttgttcgttcgttgggggttgggaaggggcgtgttaatgcgcgtgtgaaagggcggggtcgagtgacgggtttggcgggtggggaatatgtaagagttcgtcgggcggttttggagaatgcgaagtcggaggagatcggttcg

SEQ ID NO: 11231 - DNA, 433 bp, Artificial Sequence
  Description of Artificial Sequence: Synthetic polynucleotide
tcgtttcggcgtttttatcgtcgtcgtcgtcgtttaatagagtttttggggcggtttttatcgacggtgtagttcgtcgggatcgggaggaagtagttgcggttatcgcgtcgtgcgttcgcgttcggtcgttaggtgttttagtagttcgatcgtcgagatgtttagttcgtcggggtttcgggcgttatggttttgcgtcgcgttgtgcgtttttcggagggtcggcggcgttttttagttcggttcggggtttatcgtttgttcggttttttgttattgttaggaggacggtattatgttgtttgtcgattgttttgagttcgggttgttcgtcgtttcgggggatttggattttttgacggtttatttgtgagtattgttcgtttgttttcgtttggttttgcgggttgttggttagcgtttagtttcg

SEQ ID NO: 11232 - DNA, 1376 bp, Artificial Sequence
  Description of Artificial Sequence: Synthetic polynucleotide
tcggtatcggggttgtatttttgggtagacgttgtatgtttgtttttaggcgcggttttgttgttatttttttgggggttcggagcgcgatagtagtttggggacgtttttcgcgtttagtacggtgtatttgggttttgaggttttggtcgaaacgcgttaagttgggggtaggtgtagcgattttatatttttcggttgcgcgttttggcggtaggaggcggggtcgggggcggggcgtgagttggtcggggcggggtttatggaggggcgggatcgcggcgttttataagtattgcggagcgaggcgcgcgttcggttagagagcgagcgcgtaacggcggcgacggcggcgattttatcgcgtattttgttaggttttcggcgtttagcgttttacgcgttttcgcgttttcgcgttttcgcgttttttttttcgcgttttcgtttttcggttcgttaggtttttttgtcggttattcgttaggtttcgcgtcggttcgttcgtcgtttaggatcggttcgcgtttcgtaggtcgttcgtcgttcgcgtcgttatgggagtggagggttgtattaagtgtattaagtatttgtttttcgtttttaatttcgttttttgggtaagggttgcgtcgggggtcggggcgggagggggtaggtatatattttacgttgggtaggtttcgcggtagcgtgttaggtttcgcgggcgtagcgcgggtcgcgaagttgtggggttatttgtgggttttaggagcggggtggggggtcgttcggggttatcgcgtttttcgatattggggttgagggttgcgagtcgagtttcggggtttttgtgttcgggggtttatttttgcggtcgggtcggggtttttgggggtcgtcgggtagttttcgttgtggtggtgatgggtgcggtggtcgcgggtcgggattcgagtattcggtcgttttttagttaaggaggggtttgcgcgggtttttggtcgcggatttcggattgttgtttcgcggggacgaggggggggttcgcgggcgggatttttggcgtttcgtttttatgagtttattaagagtcgtcgtttttggatggtggggcgggggcgtatattttgtcggaggttgggggcgattcgttttattttttttttagtttagtttattttttaatttgcggttattattcgagatttttttgggggtcgcgtttaaaaggagcgtagattttcgtcgggatggtttagaagttggggtgcgcgtattttggtcgtttttgtttgggagtcgatttttttttttttatttagatacgttttagcggaggtttttttttagaagggttttggaggtttcgtaggagtggggatttcgcg

SEQ ID NO: 11233 - DNA, 3393 bp, Artificial Sequence
  Description of Artificial Sequence: Synthetic polynucleotide
gcgggtgtatagggagcgttaggattttagcgttttgtcggattagatttatacgttcgaggtgatgtttattattaggtatatgaagtatttgagtatgaagacggcgtagtcgggtttgcgtgtttggtcgggttgtaggtttcgtaggtacgggtagttgtgcgtggttttttagcgcgggcggttgtgttgttcgtagaagaggtaggcgattattatcgcggcgggtacggtgtagagtacggtgaataggtttaggcggattattagtttttttagtttgtgcgttttggtggggtcgttttgttgtttgatgatcgagcggatgcggaagagggatacgaagtcggttagtaggaatatggtgtcgatgaagaggtagatgattagcggcgttagtacgaagtcgcgtaggttgtttaggttttggttgtttacgtagtagatgttcgttatcgggtcgtcgtttatcgagttgagcgttagtatcgcgatggatttgacgttgggtataagttacgcggttaggtggaagtattgcgagtagtcggcgatggtttcgttgttttattttatatcggtcgttaggaattatgtgagcgataagattatttattagatggagttggttatgtcgaagaagtagattagtaagaagattacggtgtatagcgcggggtcggtggtttcgtagcgtacgtgttgttttatcgcgtttagtttttcgtattcgtcgcgttcgttcgggtcgttcgcgttcgcgttcgtcgcgttcgcgttcgtcgtcgcgtcgttcgcgtttttagcgtttttcgcgttcggcgcgttatcgttgtacgttattttttcgtggttcgttattaggcgtattaggtagtttatcgatacgaagaggtagtaggtcgagaggaagataatgggtcgtttcgggtatttgaagcgttttatgtcgataaggaaggtggagacggtggcgaaggtggatacgaagtagagtatcgattataggtcgatttagaagacggtgaaggcgcgttcgttttggttgaaaaaggggttgtggtagggtagcgcgtagttagcgatttggtttgttttgacgcggttgtagagcgggtggcgttcgttggatacgtttattataggcgcgcggtattggtattcgggttcgtagggagtcgcgtcgtcgttagggggtcgcgttttttcgttatcgtcgtcgtcgcgagttgggggcgtcgtcgcgttttcgtcgttatcgtttttgtcgtcgtcgtggtgcgggggtttggttttcggcgggcggtcgtggtcgttgttcgaaggcggttgttcgtcgggcggcggcggcggtaggcggcgcggcgggttgggcgcggcggtggttaggtcggtgcggttgtagtttatgtatagcgtgttagggttgttttgttcgggtagtcggtcgtagcgtatgcggtcgggttaggcgaagtcgtattggcgtatgagcggcgcgtagtcggttttggcgcgttcgtatatcgagcggtagggcggtagcggttttttgtagttttttaggtagatgggcgtgtatatgttgtataggaagaatttgagatcgggcgagtattggatttttattagcggttagaattggtgtatttttaggttcgtttcgttttgcgtgtcgtggttgaattgattgggtatgtaggtgtagttgtagtcgatgtttttatatagcggtacggtgattttttggtatgttagttttttggtcgaggcggtcgtagcgtcgttagagcgttgtagtagcgttaaggcggttagtagcgaggttatttttaataggtaattttattttatgttgtgcgtttcggttcggtgttttcgttttttaggcggcgcgtagaggggtgtcggggggggggtttacgagagagtcgtagacgggtatagcgggtgatttggggttttttttatgtttcgttcgggaggggggtttgtcgataatttaattttttttaggggcgcgttcgtagcggcgcggttcgtagtttgggtagggttttttcgtattttttttcgtcgtttcgggggtttgaaggcggttgtaggcgcgcgttatagttcgtaggttcgttttgttggtttcgggtcgcgtttagttttcgcggcgtagagcggtcgggtttcggtttatcgtttcgcgttcgttcgtttttttttcgcgcgttcgattattttttttcgtcgcgtcgggcggcggtgatttcgtcggatagagagggcggaggcgtcgtaagttttttttggggtcgcggtgcgtagttaagatggttgggtcgggtcgtttgtcgcgtcgggttagttttggcggttattattcggttttcgggggtttatgttcgtttttaaggttaagtcgtcgtcgtcgtcgtcggagttggggattcgtttcggtttaggtcgtcgtttttttttttcggcgttcgtttttcgttcgttcgtcgtcgggatagacggattttcgtcgtttggaaaagttagcgtcgcgtttcggtcgtagtcgggcgaggtgtatatagttttttttttgttggatatttaggagtaaatttagatcggaaggcggagcggatatttgagtggcgcggttcgcgtttagtcgtcgtttttttttcggcgggagtagcgtttttagtttaatttttcggttttagtttcgttcgcgtcgcgttgtcggtttatgaatatttatatagcgcggattcggttttcgtttttagtttcgcgagttaatcgtcgggcggtagggcggagtttacgcgtttttagggtttagttttttttaaggtagttttcgagtgttcgtattgttgtgcgcgttttttgcggatggagagttttggtaattttgggattgatcgtagagatagagtgttggttatggttgtttttatggcgttgagtgcgtcggaggttttggtttttttatttcgagtttgtttttggggatagggacggggtttggtgtagcgcgcgttttttcggcgcgttttaaattagttaagtttttgttgttatttttcgtaaatgtgggtgatttgtaggcggttggggtttcgtgtttttcggggcggtaggaaggtttcgtagtaggcgagcgtcggggaggtttgtcggggttcggcgttgtagaagattcgggaaagggtgttttttttggggtttttagaacgatggtttttgagatttggagatgtggggggtgtggagttattttaaattggggttggattcgggacggttcgggtgagatgtttcggagtttagttttgggcgcgcgaggggcgcgggggataaatgttcgttagagatttttttttcgttttcgttgcg

SEQ ID NO: 11234 - DNA, 1381 bp, Artificial Sequence
  Description of Artificial Sequence: Synthetic polynucleotide
tcgcggtagcgttagttgtatttttttttaaaaatcggaggaaggagtttgggggttaggtcggggcggtttgtaggtgtgaatatttcggaagtttttggcgttttggtttttaagagtatatttgcggttgtttacgggttttacgttttgcgatagttatttcgtggtttcgggggttttaagggcggtttttcgtatcggggttttaggtagcggaatttttttttagggtttatttataaagcgtggtgtcgtagagttttttacggaggggttttagtttggagttcgggtatcgtttatttttaattcgtcgttagtttcggattttttcgcgtttgtttcgtattacggagtcgggtttttagagtagtaaggttattaggtggcggtgttggcgtagtaggcggagcgtcgggtgcgcggggtcgcgtttttggttttcgaaggtgatgaagatgggtttgcgggtgagttttagtagtcggtataggttttttttgcggggcgggatcgttaggggggtgggtgttacgttggggtttatttaatttcgcgcgggatttatcggaagttgtggttgtattaggttcggtttaggaaggcgttcgaaagtattacgatgaggcgtcggtagcggtttaggtttattaagaggtcggcggagggttttgcgggagggcgggcgtcggcggcgtaggggcgggggcgggggagggcggggtcggaggtttaggggcggtgtcggacgtagagttttaagggaggggcggggtttgcggggtgggcgggtttttgaggcggggtttcgggtgggcggggatgggggcggagttcgatggtgggggtggggtttcgggtgggacggagtatggggcggggcggggcgggtttttcgggtgggcggggtacggggtggggttcgggatattagcgcgcggtaggaggtcgcggtcgtttaggaagagtttgtagtttcgacgtcgttttagttgcggttttaggatgaagtttacgaatttgcggttttcggggtagtcgttgtaggagacgtaggcgtcgtagagtttttcgtttgcggacggcggttagttatttcgatggttttcgaggttttatattagttttcggggtttttaatatttttaattattttttacgtgtataggggtagattcgtttcggattttaattttagtcgggtcgtatagagtattcgggggttaattttttttcgtcgtacgtttttaaagtcgagtttagtagcgtatttttagggaggtcgtggcgattttttttcgcgtttacgcgggttttacgtatcgtttatttttatttttttatacgcgttttggtattagagtagtacgttgagacg

SEQ ID NO: 11235 - DNA, 493 bp, Artificial Sequence
  Description of Artificial Sequence: Synthetic polynucleotide
tcggattcgggggaaatggggtattaacggttgggttttaggagatattcggaggggttcgcgggttcggttcggttttttcgttggggggttattagtcggtcggtagcgagatatttagaggttcgtttttttatcgcgttgttatagtaacggtttggtcggttgcgtttcgggtcgttcgttttatttcgcgggttcgttttgagttagtgattttagggattatttatcgcggtcggcggattggcgggttttcgataggtgcgtatattcggcgtaggttgtcgttgagttcggaattttgtatcgggagaaattttttagttcgtagagtaatcgtagggtagtggacgggggtcgcgcgaggataaatagcggcggcgggtgtaaagttttttttttaagtcgcggggttggtcgggaggtgtcggttgtataacggcgtttacgtgatttaggtgtagttttaggcgcgtttaagggtagttcg

SEQ ID NO: 11236 - DNA, 922 bp, Artificial Sequence
  Description of Artificial Sequence: Synthetic polynucleotide
tcgcgggcgttttgtagggatggagattgagagaggttagggattcggtttttttgggaaaacgcgcgggcgttttagtttttcgttttgcggtattttatttgttttcgaggattatcgttaagaagaggtttcgtcgtgttattgatattttatttcgttttttttcgcgaggtgttttcgagttttcgaggacgcggaacgtcggggtttttcgtcgggtaagtattagtatttagatttcgtacgtagttttgtatttttacgttttttagggaacgtcggttcgttcgttttcgggatttttcgttttttaagttaaggttttttaagtttagtgttcgcgcgttattttttttttcgattttgcggcgggatttttattttcgtattttttcgcggggttggttaagtttttagattttttgcgttgtagtcggttcggaaagttatttttaggttattttttcgcgcgcgcgcggcggcggttacggtggcggcggttgcgattcgaacgggtttttttatgtatcgcgtagggtagaggagggagcggcgtttcgtacgtcggggttggggcgttgggtagggcgggcgggcgtggggtttcgggttttttcgtatttagtcgcgcgagtcgggttttcgggtttaggggaggggagttgaggggcggagttatcggggcgcgttttcgcggttgcgttttttttcgtcggggagcgcgggtacgtaattcggagggtgttgggtcggttcggagtacgcgagtagcgggaggagggatcggggaatgattgacggaggcgggtcgtagaggtcgttgtgtttcgtcggttcgtattcggtcggagtgtgcgcgcgtagtttgttagattagcggcgggggtacgggtcgtattaagtgacggaggggggtacg

SEQ ID NO: 11237 - DNA, 719 bp, Artificial Sequence
  Description of Artificial Sequence: Synthetic polynucleotide
tcgtttttttggtatttacggcgtttttgtttgtttttgttcgggtttcggaggcgcgaatattattttaagtttgcgatcgcgcggtattattttcgttttttttttttttttatttcgttttttttatttttttcgggagtttttgggagtcgggtcgtcgtgtgcgtaagcgtgtttagtttttttttcgtttttaattcgggttcgggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcgggggtttgcggggcggggcggggcggggagtcgcggggttttcggtcgtttgattttagtcggcgtcgcgtttttcggagggggtcgggttttgtacgtgggcgtagcgcgggtcggggtggggttgttatagttttgcggagttgtttttcggggtttttttttttggattagattttcgcgggaagtcggatttttttcgtttttttggagtgagtaagcgggatagttttgcggaaagttttcgtttttaattttttagttttgcgttcggattgaagcggcggtttttatttttagtattttcgagcg

SEQ ID NO: 11238 - DNA, 958 bp, Artificial Sequence
  Description of Artificial Sequence: Synthetic polynucleotide
tcgcgttgttagtatttcgtatagttcgttcgaaatattagggaaggggttcgtaggtgtgggggtggggtggcgaggttaggtagtttggcgcgagggagagagtcgaggtttgggttaggaaggtttttgggtgtcgtgtgggcgtagagtttaggagagcgtattgttaggttcggattttttcgtttttatttcgggaagaggttcgttcgtcgtagggggaaggcgggattatagtatttcggaggagcggtcggttcgggtatgcgggcggcggggcggggagggaggttttcggaatttcgagagagtattcgtgtttcgcgggtttcgtgtttcgttttcgggtttttttttttttaacgtaggggatttagttcggggtagtgtcgggtattggcgttggcgtttcgtttagttttgcgattttttttcgtttcgttttttttcgtttcgtttcgttttttttcgtttcgttttcgggtcgtttcgtttcgtaggttcgttattttcgggtaggtttcgttttttgttttcgttggcggcggcggcggcggcggtgtcggagcgcgagtagagcggagatttttaggttttgcgggcgcggtgagtgcggttcgggcggcgggcggcgaggcgggtttcgagagcgtgcggagtcgcgcggttttgagtcggcgtcgggcgggttgggtatttttaggtcgagattcgagaagggggagcggtcgggggcgtttacgggaggtagtgtgggtagggcggcggtgggacgagaggacgaggaatagagtaggcgtcgtgcgggaagcgggtcgggaaggggagggtgggtgcggggttcgggtatcgagcgaagtggggttttttaggggatggtttcgaggaagatcgttttagaaagggagtaattcggggtcggtaagggttttcgattgtgtgatttcgtgtatcg

SEQ ID NO: 11239 - DNA, 3843 bp, Artificial Sequence
  Description of Artificial Sequence: Synthetic polynucleotide
tcgtaattttgacgagaagggttttttcgttgaaagtttaattgtagagcgttcggagcgcgttgtgagttcgtaggaacgcggtcgggtcggggacgggagaaaggcgcggtcgggattttgtattgtgtcgcgcggcgtttgcggttggaatttggtttggaacgcggttttttcggttttagtttttcgtttaggtttcgtttattcggtcgtttcgttggttcgtatcgttgtttcggttatcgaggagtttaaagttggcggcgtttcgcggatttcggcggagagcgcgagggagtcgcggtcgatttttgtattacgaagataattggaggtcggcgggggaggcgggttacgaggggttggggcgagggagttgggatgcgcgggttcggttcgtcgggaaataggttgtcgcggagtttcgttttttttttttttgcggttttcgtcgcgatttgattttcgttttgttcggggagttaatttagtcgttttcggggcgttttttttttttttggatttttacggttggattagagtttttttggtagtcgggttaaaggtttttttagtaaggttaaggcgcggtcggttggtatttggggatttttttttagtcgagtattggttttttaatcgtattgttaaggattatggtagcggtaggaaattcgaagggttttataggtttgcgggagggaggatttattttatagtaaggaatagatttagatagatcggggattttagtgggaggggacgagaggttttaggacgttggaatgtggtaaaaataaaatattttttatttatgtatattattattttttgattgcgggttggggggaagggagtttagggttaatgtgttttagattttagcgttttttacggttgtgttagggttggggtggtttatttttttatagacgaaaattaagatttaaaagtatatttttattgtggtttttttattaaagtttattaacgtgatatataggttgcggcgttggagggaagcggcgaaacggggagaataaacgtaatagaagtaaattgttgtttgtagaggcgagaggcgaaggaacggaagttatattcgattttagttttatttcgtttttattagcgtcgggttagcgtaggaaattaggaataggtgtaggtaagggtggtagttcggtagagttagcgttttattttttttaatttttcgttagcgtgggtttggatggttgggttgtttgggtatttttaagggggattaggtatcgcgggtaggtttttaaatacgtgaagggtatagggtttgaaagataaggaggggcgtttaggaagggcggaaaagaggggttttggggttttttaggatattaagttagtttttgaaaacggcgttttttggaaggttttttaatattttcgagggaagatttggagttttgaagatttaatgaaattttagttttgattgattttttttttgcgattaatttcggatgtttttatttagtttttgtttcggtaatcggttttttggggatagtagtattagtattcgacgtttatcgtataagtgggcgtcgtggtgcgaggcgtattttagttatttaggtcggggtgggggcgtttcggtatttatattttttaagtaggtaaatttttaggtttgtttttcgagaatcgggagttcgtattatagtttcgggtaattatcgaggtagtttatgtaattgttcgcgatgtcgtttagtagatttttttttttattcggttttagagtttagtatatgggtatttttttttttttattttttatttcggcgattggaatttcgagtttgttttattatcgttttttataaagtagcggggtgatttcgtgtgttataaatattaagttagtatgtaggtttaggtaaaattttggttgtttttttgcgttttttttattgcgtcgatggtttatagataattgtatttttataaattttttttttacggttagggggtgggagggagttagagatcgggtgggggtttggcgcggtattgttgagggttttgtatttaattgagtagtaatatatttatttatatggacgcgggtgtataaatcgttttaatattttgttttgaaagcggagttaatttttaaagttaaggattacgtagttgaatttttagtattttttaatttcgtttaggcgggggtaggtagagaaggggcgggtagcgggtagttaattcgttcgattttttcgttaagaaggatttattaggtgaatttttcgttttttatttaagtagttggttgtgtatttttcggttgcgtgtgtgtgtttatatatatatatatatatatatatatatgtcgttttattattttttagtttgtttttttaatgtaacgatcgtatttaaaaatggtaattaaaatgattgaggagttcggtgattatattttaatttagagtatatttttcgaagttgggggtgagagtagttatatagttatatttatattcgggagttttttaagcgtttatttggcggttgtagttttagttggtttttagacgaatattaatatcgcggtcgggcgttcggtgaggagaggcgggcgtttcgcgggttgtagagggcgaggagttggggtcgtatttttaggatttgagttttaattatcgttcgtgcggggttgttgtagtcggtatttgtttcgtagggtaggttgtagtcgttgaagttcggcgtcgtttcgcgggtttttttagcgttcgacgggggtttggggcgagttagtttgtagaggggttgtaggcgatcgggtcggggcggggaacgggattcgggagaggtagacgaatttggggcgcgtcgttttttttttattcgttttttatttttttgtttttttttaatttttgtttttaggttttagttcgcggcgggtttcgggggttgcggcggttttaggttttagaatagtttgttttttcggttattcgcgttttagtttttttttttttgggttaggggagtaagtaaatatttttcggagttttcggtagtcgcgtgagttattcgaattttgttcgggttagtagtgtagagggcgatggagttggcgaggcgtcgtcgcggtttttaaggcgttttttcgtagagcggattacgtcgttttatcgtggttgtaggttgttatcgtcggggaagcggcgaggacggcggtagggaggtaaggcgtcgcgtcggtggtttttttttttttcggcggcgcggtttttttgtttcgcgagtcgtagcggggcgtttaggaaggagtaggttcgggttttgcgtttagttttagcgagattaataatagttttcgcggggagcggagttttagcgagtttttagtcgcgcgcgtacgatcggttttcgttttcggtcgttttcggtcggcgtttttgttagtattgttgttttatatgaaatagttgtaatttcgaggtttttggggggttggggcgggtgtgtgcgcgcgcgtgtgtgagtgtgtgtgtgtgtgtgtgtgtttaatagtttttttttttttttttttttttttgtttgttcgtttgtttgttttcgttttttattttcgtttttttatatatagaaagagagggcgagcgagagagagatatatatatatacgtatacgtatacgtaggttatatgaatgggaggcggtagttaattttacgaggtcggcgagtcgcgcggcgtattggcgttgggagtagggtcgtatttcggcgcgggggggcgttacgtaggtgatgggcgttttttcgggggttacgcgcg

SEQ ID NO: 11240 - DNA, 384 bp, Artificial Sequence
  Description of Artificial Sequence: Synthetic polynucleotide
tcggaagtcggggggcgggtttttatagttattgttcgttattagttcgttattgtgtttatatagggtgatttgatttcgaggcggtggaggagggaataattttagagagtatattttgtcggttcgtaggacgtttgtagtcggtaaatttttggtcggaacggtatagatcgtattttcgtaattcggttttcgggttagattcgtatgcggacgggtatcgtaagggataaacggcgaggcggaatttaacggaagtgaagaaaagattaacgggaaagaaggacgagtacgcggtttcgggatagatttttaaagtttttttttgcgttttttggcggtcggagggggagtagcgcggatacgtttttcggttaatcg

SEQ ID NO: 11241 - DNA, 1432 bp, Artificial Sequence
  Description of Artificial Sequence: Synthetic polynucleotide
acgttttgcgtttttagtcggggtttttttattcggcgtcggcgcgtagtatgtcgggagttgtagttttcgcgaggtaagtttcgtttcgtttttgtttgggggaggaggttggagagtcgttttgtcggtttttgaattttgtcgcgaaaagcgcgcgtggcggttttcggtttcgtttttcgtaggacgcggtgtcgcgttattttggtaatcgttttttagtcgtcgttgattgggttgggtcgcggggggcgggcgggggacgagacgcgggggttgttgtcggcgttcgcgtttgttagtcgggttagagcggagtagcgggtaggattgtttggtcggttgtttcgcggagaggttgcgcgcgtcggtcgggggaggcggatagtcgggttcggcgtttgtggggcgcggcgcgcggtattcgggtttgagattaggcgaggcgtcggcgcgcgttagacggcgcgaggttgcggtttcgggagttttcgcgcgtcgttcggggttatgggcgcgtgagagtttagcgcgcgcggtttttgttgcggtttgcgagttcgtatattcggtgtatagtttttcgggtcgttttcgtgttcgttttgcgttattgggatcggttgttttttagcgtcgaggttttcgaggttgtattcgagtttgcgtcgttcgttgtcgtcgtcgtcgtcgttgtcgtcgtcgttgttcgtcggttttttttttttttatattcggggtttagagtaggaggaggaggggtcggtgtattttcgtcgttgttttttgtaatttgtaggggtcggtgtatgttcggcgaggagtcggggtcgttgcgggtgcgtgtaattttcgaaggagataatttttttatttcggggcgaattcgggggttgtaagtcgcgggcgggcgggcgagcgagaggaagtaataaagataggttgtagttggggttggcgaaaggggtcgcggtcgtcgggtttttagcgcgggcggagagggcgttttgggagcggcgcgggtcgagttgtagttttgagcggggtttcgaggggaggcgtagcgtcgttcgtcggacgtggcgattacgggtttcggcgaagatgcgtcgtttgagcgttcgcgcggttttcgttcggggcgggcgtgatttttgttgaacggagattttttttttttttcgatttcggacggcgtaggtcggcgttaggatagtttttatcgatagcgtttttttttattcggagagaggtatcgatttttaaggagggtttcgttaggtagtttttgttatttttgtatggttgcgattcgtcgagcggagcgtcgtggtagttgagatttggtgtttttcgacggtttggttgattcggtgagttgtgcggggcggggttttgcgttggagttgggggtattttttggcgttcg

SEQ ID NO: 11242 - DNA, 325 bp, Artificial Sequence
  Description of Artificial Sequence: Synthetic polynucleotide
acgttagcgaaggtcgtttcggcgtattttagataatgagcgtagtgtgtaggagcgaggggttggtagaggttaggaagtttttggggttaggcgcggttttttatttttacgttagataaagagcgcggggtttggggagttggcggttttttcgttatttggggcgtttggggggttttggggcgggggaggcgggggttttgtttaatttcgttattgttattatcggttaggtcgcggtttggtaattcgtgaataggaggtagggttgtagggcgtgagggatgatgataaggaagtcggaggagtagcggcggtagcg

SEQ ID NO: 11243 - DNA, 1242 bp, Artificial Sequence
  Description of Artificial Sequence: Synthetic polynucleotide
tcggttttggtttcgtttcgtacgcgttggtgttatagttgtggtgtagacgttttttcgttgcgagggtgcggtcgtttcggggcgagtgtttttcggtttgtaggaggcgaattcgggttttttcgggaggcgttcgtgggaacgcgtatttgcgagtttttgtcggttgaggagtcgaggtttgcgatttttgtcgatttgagtttaggcgtagtagcgtagatttggtcgtcgtattttttttggttgggatgcgggtttacgcgggaaaggttgaaaggtggggaatatttcggcggaaaggaattttttttttttgttttgaaggaaagttttttaatatagttatgtttttggtggttttcggttttttatttttaagtttttagttagttttatatttattcgttttagtagtcgcggagtgggggtttttaaagaatttagttgtagagtaagttcggttgacgtagtgtgcgttgggggcggggttttggacgggggcggagttacggcgagagtcgcggtgagggcggggttcgggtgggcggtgttttgagcggggtttttagtgggcggggttttggggtggcggtcgttgtcgggttacgggagagcgcggagttttgcgttgggaggtgtacggtgtgtacgttggattggatttttatgtaatttcgcgttttgcgttttaattaggattgtttcgcgcgtttttgagtttcgggtttcggttcggatttgtagttttttaggtggttgggaaggtaggtgcgtcgttgttttcggcgcgcggcgtttcgcgaggtttttagttttcgttttggtggattttcgttgggtgggagtcgggagtggaggcggtcgttttagggagggaggagcgtaggcgggggttgtttacgggcggagtattgcgcggcgaagggaattttcgaaggggttgatcgggtttcggggtcgtgataggcggcgaggcggtgggaggggagcgtgtgaatttacgtcgggttttcgcgggcgacgcgagcgacgcgatttggatttttattcgggatattgtaaatagatttgtttgtgaggtttacgattgggagtttgttattttgtttaagttcgattcggtttcggcgttcgttcgcgttttgcggaggttttttgagttagcgcgcggttgtaggggtttcggggtcgtatttcggattagcgttagcggcgggagagcgttgtttgtgagcg

SEQ ID NO: 11244 - DNA, 1460 bp, Artificial Sequence
  Description of Artificial Sequence: Synthetic polynucleotide
tcggggtagtcgagttatttttttaaagtcgattttcgggagagatttttagttggacgtttttcgttttttaggagcgatggttgtaattatttcgttcgtttttacggggcgtttttttaatttttcggttggttttttttttcgtagggtttttttcggtttatcgttttttttttgcggttttttcggttttttaggtcggatcgaggttagcgtttgatttttttggtttttagtttgtttttttagtgtttaagagcgagaatatcgttttcgtttatatgtaaaggtcgggcgtagtaaatgaagtgggaaaagagaaaaatagataaatcgttgtggtataaaagatttttttttcgttcgttttgttttgtagttcgggtttagtaggagagggttggggagaattggataaacgttttggaatttataaaggtcggtggtgtcgggggtcgtaaagggagtgaagaattgaagtagtgagttggataaattcggggtaaagtattaaataatatggatattttggtaacgcgtgcgcgtgtgggtgggcggataaaaggatttattattcgtatgattgttttaattttttattttttttgtgtacgtgtgtggacgttgttttaggttcgagttcgtttttcgtttaggacgtatagtttcgggtcgtggttttcgcgcgttcggttgtgcgtttcgggtttttggttcgcgcggtagttatagtttggcggggtttgcgcggaggaggtcggttaggcgtaggttgtcgattttttttatttcgtttagagtagtgcgtagtttttgcgcggacgggtagagtagtcggcgcgttagttcgcgcggtatcgtcgttcggtcgttgaagcgcgcggcgagtacgaaggggaaatcgaagcgcgcgcggtattgcgcgttgagttcggttagtcgtagtcgttcgttcgcgtttaggttttttaggtttgcgtcgttttgttttcgttgcgattcggtcgtgagcgtgtttcgttgtagttcgttgttcgttaggttcgggtggtagcgtaggatgtttttttggtttgcggagaagtatagatatcggcgggagcgcgttaatcgcgttcgtttcgtatcgcgtattcgagggggcgcgtaggtcgcgttcggtttttttgtttcgtttcgtttcgttcggttttaaagaaggttgcgggagggtgaagtagagtatttaggcggtgatgttttggcggaataggggcgtttttggcgcgtttttttaataagttttggattttgcgtttttcggtttttattatattcggtcgggattaggatttaggggcggggcgggaagtgatacgtttgttttttgagattttgggttaagaagagcggaggagagagagggcggtcgttgaggttcggaatttacgattaggtcgggagggagtagagacgcg

SEQ ID NO: 11245 - DNA, 1064 bp, Artificial Sequence
  Description of Artificial Sequence: Synthetic polynucleotide
tcgcgcgattgaggcgttagcggcggagttggacggtttgggaaggtttcggtttttcggttgcggttttagttcggacggcgtcgcgtaattttgttatttttttggtttagtttcggttataggaggatttcgcgggtaacgcgcggagtttttggtatttttcggcggtgttttttgttgtttgttcggggatcgatttcgtatgtttttaggttgatttgtttaagttcgaatatcgggattatgtatttagtcgggattttcgggttattttcgcgtcggataggtaattttattagtttttaattaggatcgttatcgtcgtttcggttgttgttgttgttgttgttttttttgttattggtaagtcgcgtttcggtatagttcgttgttttcggtagggcgttgttgttttttggtttcgcgggggttgtaggggtttttgttgaggaggttatagtgttggcgaatcgcggatttcgggtgtttttcggtcgtgaagtttggttggattttttgtatgatttggtgttgtaggtgtagttcggggatcgttgcgcggtttcggtattagataacgacgtattggtttagcgatcgggtcgtttgagttttaagcgtttttcgtgcgattttggttttggcgaggtgcgttatttttatttgggcgcgcgtagttcgtttcgggatcgcgttcggttgtagttgcgttatgacgcgttcggaggggtagtagtgttattattggtattggaggtggaggtggtttttatttagttggaggttgtgattcggaatttgtttttggtcgtggaagagttgttggggattagtaatgttttggacgcgcggagtttggagttcgttttttagttcgagatagaggagtgtcgcgtgggtattttgttcggtttgggcgcgttgtttcgttatggagaatttttttattattcgtaggtttttggaggagttagagagggaggcgtttcggagatttttttgatggattgtaaagttttttaggaattaggcgtgcgttatcgttatatagtcgttagtcg

SEQ ID NO: 11246 - DNA, 622 bp, Artificial Sequence
  Description of Artificial Sequence: Synthetic polynucleotide
tcgttagttagacggtgtttttgtcgtttttgtcgttattcgttgggtttcgtttcgttttaagcgtattttcggttcgtagggtgggaatacgaggattatagtgttttacgggcgggcgggttaggatcgtaatttcggcggagtcggcgtttttgggtatttttggttttcgcgtttcggtcgtacggtgattattcgggaggggatttcgggcgtttcgtaatttttcggttttcgtgggttttcgggtcgtttcgtttttcgtcgtcgcgtatttttcgcgtttttcggttttcggtgtcggttttcgtttcgcgtagtttcgagtttttagttcggtcggttttttattcgtcgagcgtatttatggcggcggtttttagggtttttgcgatttgtcggcgggacgtgtttttggtaggtgttattttttcgatttgacgtttaggttcggtttcgttgttttaggtatagttttagttttgcgaggcggggtcgtcggttttattcggggggcggtgttgcggggagtagaggttcgtgttttcgagtcgtcgcgcgtggatattagtttcggtttaggtgcgggtgggtttcgacgggagcgcgtggtaggtcg

SEQ ID NO: 11247 - DNA, 1622 bp, Artificial Sequence
  Description of Artificial Sequence: Synthetic polynucleotide
gcgtttttaaaatcgagtttatcgttttttttttttgcgtagtttttatttttttttgtgtttcgtattttaataaacgttttcgttaagtgattttagtttgaaatatgcggtttttcggatttttttttgtgttatcgattttttgcgtttagtttttcggagttgtcggtttaatttcgtaagttttttcggaattcgtgttttttttttgggtagcgttattattacgagcgtttatttgagaggacgtttgtttttatttagtttttattttgtagtcgagtaattttcgtaaaacgaatatttggtttagtttttgttggaaatcgttgaatagtttttattgttttttggaagggtttgggtagttcggcgtggcgtttacggttttattaggtttttgttttttgtaggtttcgttatttcgttattaaagcgttcgtcgcgttcgtatttgttgtgaggttgtgttcgggtcgttttcgtcgagggaacggtttttttaaggttttgcgttttaattttcgttcgtttgttaagaggtagtcgtgtcggggagttagagtttttcggggatttttttttgtttttcgtggttttttgtggaattttcgttttaggatttgtacgtcgtttttagtcgcgcgcgcggtacggagatcgttcgttgtgtttcgcgttgcgtttttttcgtttttttttcgcgtaggtttttttgtgttagtcggttgtcgatttaggttaggaagttcgaggtcggggcgttattttaagggttttttcgtttttttttcgagggtagagaggcgttcgcgttcggacgtattgcgggaatatttggagcgtcggcggagttcggttgttttcgcgggagggagttcgacgcgtatttttgggattcggattcggcgttcgcgtttcgggacggatttttgtttcggttgtaggcgtagcgcgtagatttgagtttgtttcgcggaatcggggttcgagtttcggttcgagcgcggcgtcggggttagcggagaggggcggaagtcgtaagggattttcggcgtttcggtttggtcgcgatgaagttttcgtttttttttaggtgacggatcgtcgttgtcgtttcgggttgtttattatttcggcgcgtgttcgggagtttttatttttttcgggttttgtggtcggttacgcgttttaggtacgcgtcgcgtcgggtcgcgttattaagttcgttgtttttagtttttttcggtagattttttggttatttttattttgcggaggggtcgtttattagatgttagaaaattagggtggggtacgtaggttaggggttttagcggttgggtatcgtgtttttttcgaatttggtgttggaagtgcgttcgttttcgttttttttaggtatttatcggtattgtttagttttgtttggagggtttaggattgaacgtttgttttcggtttttattttggttgtagaggattggtcgggtgatgtcgcgttgttttggttttgggttcgtttggaagattcgtttgtgtcgcgggttttttttttggttttggtttttaaagcgttttcggtatagtttttcggtttttgtagttcggtggggtcg

SEQ ID NO: 11248 - DNA, 324 bp, Artificial Sequence
  Description of Artificial Sequence: Synthetic polynucleotide
acgtgggttcggagtagggggcggcgttcgcgtttgattcggtttgtcggttgtttgtcgttcgcgtaggagttggtcgggcgtcgtttgtaggttgtttcgggtcgagtcggagcgacgttgtcgcgtatttgggtagttttcgggggtcgcgttgtgttacggtcggggtcgttgcgattgcggcgtttgtatttgttacgtgattgagtcgggtatgtttttcgggtttttgtgtgagtgttatgagtgggtgtgcgagatttacgacgggagtatttgtgtaggtaagagggcggcgttgttttttttttcgggaggtcg

SEQ ID NO: 11249 - DNA, 1881 bp, Artificial Sequence
  Description of Artificial Sequence: Synthetic polynucleotide
tcggggttttttagtttcgtcggggcgtttgtttttcggttgagttcgttcgtagcgcggttttcggttattggcgaggttgtgcggaattagaaggtcgatcgcgttcgggtatttttcgcgcgtttttgattttagttcggtttttcggaagtcgtttgggcgatttcgcggtttaatattcggttttgcgaaatcgttcgcgttttcggttcggtttggagggtttcgtattattcgcgcgcgcgcgcgttcgtataggattcggttaataggcgtcgggatttttggagttcgttttgttagaaatttgttacgcgcgtcgtcgtatatgcgttttaggttttttcggacgtaggcgttatcgatttcgttttcgtttcgcgtttttcggttgtttcgtcgcgatttcgggtcgcgagcgttgtcgtataggcgttttaggtttttcggggtataggcgtcgtcgatttcgttttcgtttcgcgatttcggtacgttttacgtttttcgtattttagattcgtttttttcgatttttattggatagtcggggaaaatggcgttttaaagcgttcgtatttattttgtcgaaatgcgcggtttagtgtacgggcgtttagttatagaaggagtttttagaggttaggtgggcgtggggtgtttgttgtagtagcgagtagagcgtggttaggttttcgtcgcggtaggcgcggtgtagcgggaaacggagcgagagtagtttttcgttggagaagttcgtttttacgttcgcgttcgttttcgtcgtcgatatggttcgttatcggagagcgcggggttcgttggtttagaggacgcgtcggggaggattcgagaagtcgtcgtcgtagtataaaggaacgagattagcgtcgcggtcgcgttttataggttgtcgagcggagcgcgtatagagggggcggggcggggtttggagcggtcgggttgggggcggggtttggtttagaggacgttttgtgtagtcgggtaggggtcggggtttggagtcgcggatttttggagtcgtcgggtagggggcggggtttgagtcggaggtcgtttggagtagtcgggcggagggcggggtttggagttgcggacgtttggagcggtcggtaggtggcggggtttagtttagaggatgtttggagtagtcgggtagggagcggagtttggattagaggacgttagtagtagtcgattaggaggcggggtatggggttgtcgacgtttggagtagtcgggtattgggtttgggttagaggacgtttggggcggtgggcgtttggagtagttaggtagagggcggggtttggtttgggtttacgtttggggcggtcgggggcggggtttggttggaattgacgcgtggagtttcggtggagggggcggggtttggttgggtcgttgtttatagcggttttcggggtttggaggttacggggttcggaggttacggggttcggaggttacggggttggttgtgtggggggtttaggggcgtagagtggttaagtagcggtttgagcgggtttcggggttttcggcgcggtgggtttcggttgcgtttcgggtgcggattatgatgtttttagtttgggagtcggttcgggcggggaatttcggttgtcgggggcgcgggttgaggttttgcgggttcgcgtttagagcgggtgggagttacgggtttttcggaggtttagtagcgcgcggtgaagttgtttagtaaaaatttatggagcgtttacggggagtagggattttcgttaaaatttgggaattagtaagttttagttttttatagagtaggatagatttttcggttttgttcgagggacgtttttttcggaatcgagtgcg

SEQ ID NO: 11250 - DNA, 944 bp, Artificial Sequence
  Description of Artificial Sequence: Synthetic polynucleotide
tcgcgtggggtttagggaggcgcgggttgcgggggattgcgtaaggtcggggtttttggaggtcgaggtcgcggtgtttttcgcgaggttattatgagttgagtgtttttggtaggcgtttagggatttttcgttttttttttttcgcggtttcggcgggcgtcggttagatcgtttcgttttttcgttagttcggaacgttttgtattttttttttcggttgttcggcgttcgttagcggttagaaattttcgtttcgttttatgtaatcggggatttcgcgttttcgttgtcgtttcgttttcggtttagaggacgggtttggggggagggggcgtgtggcgacgttgttatttattagggtttagtcgtcgttttttcgagttgggtcggtgtttcgcgcggttttgtagttttgtagcgttcggggcggtgtaggagtttcggggtgtcgcggcgttcgttcggttgtatcgttggtttttcggttcgggttttaggttcggcgttttttatttttaggtcgcgcgcgtttcgttttttcgacgatttttagtttcgggttttcgttatttacgagttttcgttttcggtgagttgttgtttttagggtttcgagtcgcgcggtattttttgcggttcgaggcggattttttgtagttttttgattatttgttcgtatttttcgttttttatggagtttaggtcgttgtcgtggcggtcgtttagtagtcgttttttttttagttcgtcgcgggggttttttatggtttatttttgggggcgttcggtcgtttggaatatggcgcggacgagttgcgggcgttgttgcgggtgcgttgggtcgcgggttgcgcgttgttttttcgttggggcgttggcgggcgggacggcggtacggattgttgtgggttttgtagcgtcgtcgcggcgttttataaacg

SEQ ID NO: 11251 - DNA, 1514 bp, Artificial Sequence
  Description of Artificial Sequence: Synthetic polynucleotide
tcggcggcgttttttttatttagcgtgaaatttacgaggcgcggcgtttcgagtggcgggcgggtagggggttgtaggatttacgaagttattttcgtcggggatcgttttttttcggagtggtttttttttcggcgtttcgttttagtaagacgatatttaggttaaatagtcgttttcggttagttcgattcggttttggagggagcgtttcgagggagtttagtcggaggcggagaaggttattcggttagaaggtggggagtcgtcggcgttttttcgtattttcgtttttatagtagggggaaaggttttgatcgtcgtggtttatattatcgcgtttatttgaggttcgtttcgttttttgggtttttagaggggtggcgtatttcgtttttttttgtttttaagtggtcgtattttttcgcgggacgtttggttgggtttagggcggggcgggcgggcgtttttcgtattgtcgcgagtttagcgcgtagttttcgcggttcggttgtcgtcgcggttagttggggcgggtcgggggcggggttttagggggcggggattcgggggggcgggtcgggtcgggaggcgtgggtggggggcggggcggacgcggagcgtttttttggttggcggggttaaggggttgagaggagtggggtaggttcggcgtcggtaggaagagttagaggggtgattagagagtttaacgtttggtgtttaagatttttttcgaggtatgaataagaattaggcgtttgggtttttttcgttcgttttatcgtttagtcgtcgcgtttcggacgttcgttgtgttttttgtcggcggggcggcggcgggattgggtttcgggagggtttttggaagtcgcgagttttagcgaaggtagtgtatcgtttttcgttttttttttcgtttttttttcgtttttttagttttgggtgtcgggtatcggtggtaaggtcgttttttcgtgagtcggaggtcgtttattttgggacgggcggacgaggttttagggtagtcgagttcggtagcgggggaggcgtggagttcggggcggttttagcggcgggggcgggaggttggttttggttgtagattgcgcgtttgggtttcgtgcgcggtttttggttttttgtatcgcggaggttttcggattatagggttttttggcgggtttcggtatttaggtttgtgtcgttgtggttgggcgtcgggattagtattcgagtttcgcgttttcgggggttgcgtcgtgtcgtttgttgtgcgcgcgtagaggtcggatagttcggttgcgggaagggattcgagcgtagggtttgtttcgcgtttcggaaagtgtttagtttgcggagtcggaggttgagttggggtagatcggcgttagacgggggtttgggtgagatacgagttgggggtgcggtttgtagaatttgggtttttggaggagtttacggcgcgttggcggagttttaggcgaataggagtatcggattcggtttcg

SEQ ID NO: 11252 - DNA, 2144 bp, Artificial Sequence
  Description of Artificial Sequence: Synthetic polynucleotide
gcgtcgtttttttttcgcgtttttcgaatgttaagtgtattagtttttaattttttttttgggcgggttcggtttggttaattttagttgtagattttagtataaatttaggattttttttcgtttagtcgtttttatataaggattcgtcgaatatattttgaatttcgcgttagagcgtagttcggaattgtagttcgcggcgcgggtttaggtcgggggtcgcgcgtttttagtcggtgatttaaggtcgttcggttcgggggtgggtgtgggtcggtaggatcgattagggtcgcgcgggggtagttgtcgggcgttcggttatttagcggtgggagtcgaggttggttttggttagtcgttatttcgtcgcgggcgtttgtttcgtcgggttttcgggcgcgggaggaaggttcgcgtcgttttttattcggcgcgttttttttttagtgcgtagtggtttggtgggttagtcggcggcggttggagcgcggggtcggttttgcgtacgaatgaatgggcgttcgggggacgcgcgcgttcggggttgaagggtattaggatcgtgaggatcgtttcgcgattttgtttttttttattattttttcgtttttttattttttttttttttttgttttgtaggattgagtagttaggcgcgagcgaaaataaatagttggggttgcgagcgttttcgtttcggtttcgagagtacgtcggtttagttttttatttggggcgttcgtttgtttattatgaggaagattcgcgttaatgttatcgttattttgatcgtagtttggattttgggtattttttattatttatggtaggataatcgagtttacgtagtatttttcggcggtcggggcgcgtagagggtaggtaggaggtcggagtagtttcgcgaggatcgtattatttcgtttattgtgagtacgtttcgagcgtcggtcggtcggttagggagtcgcggcgcgcgtttagattttgcgcggcggtcgagggcgcggggttcggttagggttgagtgttcgttgcgtcgggtcggttttgtatatgttggagtatttttgttcgttgttatggtaatttttgtcgggcggcggggttggggcgtatcgattaagggagggtgatagagggtgggggttgggagaaagtgttgtaagtttggtgggttcggcgtgcgcgcgcggttgggaacgtggcggttttttcggttttgcgttgtcggggtcgggagtttgggggttgcgggagtttcgtgtgtttcggaaggttgtcgggtttagcgcgcggcgagcgggcggtgggaattattcgtagtcgagcgcgtaggtggtagtgcgtagtttttttttagttttttgggggtagaggatatcgggtgggggcgtgggtaggggaaggttttttaggcgttgcgtttggtttcgaatttttttttgagtcgggttaatttgaattcgttttttcggcgcggatatttagttttttcggagttttttgggttgaggagaggtttcgtattgtacgcgttttttatttttaattttagggttcgttattacgggtaggtgggtagtgttagcgttcgaatttggcgatatttttgtatgaagttagtttcgcgatatttaagcgggtagggaaataaaggtagtgtggtatagcgggggcggcggcggggttgcgggggtttttggcgttttggggattcgggcgggggcgtgcggagtcgtagtcgttttgtagggggcgattttgtcgtcgttttcgttcgagttttaggtgatagagttgtgcgtggttaggtaggggtatttgttgaggcgggaggttttggtattcgtcgagagtgcgttcgagcgggcgtatttttttagacgggggcggttggtggacgagagtttcggacgattttcgggaattattagggcggggtagtttggtcggatgaggattaggaagaggagagtcgagtggggcgggggtaaaggagtgaggaagcgtggcgatttcgataaggaaagatttgggtttgggggtggaggggtgaggagattcgcgggggaggtgtaaggttcggagggttgaggtttgtgtggagtcgaattcgagaaacgtatttagacgcg

SEQ ID NO: 11253 - DNA, 379 bp, Artificial Sequence
  Description of Artificial Sequence: Synthetic polynucleotide
tcgttcggcggggcgtttttacgttgtgttttttgcggtgtatcgaggcgtattcggttgttttgttgcgggttttttggttatttgtgggttatagggagagacgcgtttatatattttcgttcgcgtttaggatagttgcgggagtttcgggtcgttttaatttaatgcgtttttcgtaggttgagatgcggttgtttttgttcgtgtcgttgttgttggttttagcgttcgggttttcggtgagtgcggttttgtttcggttttcggaggaatttgtaggggagtcgggggcggggacgcgcgggttcgtaggtaacgtttttaggaaaggggcgatgttagggaagttgggttgggaggaggcgagttcgtatcg

SEQ ID NO: 11254 - DNA, 637 bp, Artificial Sequence
  Description of Artificial Sequence: Synthetic polynucleotide
tcgcggtacgggagtgcgtacgcgcgtcggaggcgaaggaggaatttatcgtatttatagggcggtcgagtgagggagttgttggcgggtgggtttggtaattttttgggaggtcgacgcgggcggatcggcgggtgttgggaatcgagtttcggtttgcggtcggtagttttcgtgggtttgtgaagaggtcggcggtttttgcgggcgttagttaggtaagtttagttcggtgttttttaggaagttcgtttgcgggcgcgggtagggagtcgtatcggttatggtggttgaggagggagaggttgttgttcgtcggtcgttcgattttaggttttttttcgacgggttcgtttcggggagtaggggtgcgcgggggttgtttttgcgcgaacggttcgggcgggggacgtggggcgcgttgggcgtcgttcgtcggtttaggcgcgcgaatttggcgtttttagtgaattattcgcggttcgggcgttcgggttcgggatcggtttttttttttttcgttgagtcgcggtcgagttggttttttgtattttatttagcgtcgtcgggacgcgattatatcgagatggtatcgagttttttttaaaggtttcggtttgttgaaagtggggcggcg

SEQ ID NO: 11255 - DNA, 959 bp, Artificial Sequence
  Description of Artificial Sequence: Synthetic polynucleotide
tcgcgggatcggggggatggtcgatttttagatacgggagggattgagcgatgtttaaggagagtaggagaatattgcgtttggagatttttgagagttaggggcgggtcgttttttaaagggatttcggagtttcgatttttagttttagttttttttgtgatattatttttcggatagagatttaagttttaggttcggtttcgtttagaggttttagggagaagattaggttatcgtttattgttcggcgtcggggaggaaagaggaggagtttttgtgtgtttatatttttggtcgtttagggtagttcggttcggtttcgtaattttagtttattggttcgggagattttaaaggttttatcgttagcgtttttagcgtttattgtgtgcgttttattttagttttgtttgcgcgtcgttttcgttattttcgttttagtttttgggtcggaagtttttttttttttttcgtcgtagtttttttttagttttttttttttcgtcgatgcgggaaatttttttcgtttcgtttcgttttttttttttagttgtattttcgttcggttttttcgtttagtttttaatttaggtttcgtttttttttatttatttttcgttttgggtcgggttttcggttttatcgtttttttttcggtttcgtttcggttttcggaagttttatttcgttttcggtttcgttttttcgaagttttttgggttttcggtagtcggcgggatagaacgcggagagtcgtcgtttggtcgggcgtagacgcggtggtagagttcgcgcggcgttggaagcgagtggcggagcggcgggatttcggcggattcgttatggaggaggaggtgagggcggggttcggcggggcgttgggttggggttttcgagttttttacggggattgcggttttgggtttaggttttcgtttttgttcgttttattttcg

SEQ ID NO: 11256 - DNA, 826 bp, Artificial Sequence
  Description of Artificial Sequence: Synthetic polynucleotide
tcggtcgttagttttgggagtttcggttgggcgacgaagttgcgggttggggtatcggttgtttttacgggtcggttttgatttaggggttcggttcggagttgttttttcggcggcggggttgatttaattttttttgttcgaggagttgtcgcgcgtagttagcgtttcgaattcgcgcgcggttcggcgttttttcggggtttatttttcgggttagtcgtcgcgtttatttgtgttcgcggttcggttttttttcgttcgcgttgttttagtcggggttgaggtatcgggtcgggttttcggcgtttcgagttttcgttttttttttttcgttttttaattcgtttacgttttcggttttttggatggcgacgcggatttgtatcgtcgttttgggttcgggtcgagttttttcgtcggattgggttatggttcgcgggattgcggcgtcgtcggggtttttacgtcgtaaggtttagttagtcggtcggtagcgattgcgacgagggggcgggggcggtgcgagcgcgtttgtcgttcggtttaggggagggataggggtcgcggcgtttcgtttcgcgtcgtcgtcgtcgtcgtcgtcgtcgttattatttcgatcgttagtggagcgttcgcgtaggcggggtttcggaggtggagggcggtttttcggagttttttcgacggaggttcgtttcggaaggattttcgcgattttcgattatttttttcgttttttcgtcgttgtggggttttagttcgagaggaggtgttagggttttttttttttgcgtttttttttacggcgtcgtagggatgggcg

SEQ ID NO: 11257 - DNA, 2156 bp, Artificial Sequence
  Description of Artificial Sequence: Synthetic polynucleotide
tcggtcgatttgatttttttttgttcgcgttttacggttttttggttgtcgaatatttttagggagaatttgttgatttcgggttggagtatggtttcgaattggcgttgtatgaagtcggtttggtttaggcgtatttcggttttcgggaggatttggtcgtcggtagtcgcgtttttttttattttgatagcggtgtttatcgagggttgttcgtaggaggcggaggtcggttgcggtggttgttggggcggcggcggcgaggttgcgggttgcgtcgaggcgtcggggcgttcgggttcggtcgttaggtttgggggcgttttgttttcgtcgggggacgcgtcgttttcggcgatgagtcgtcgttttttcgcggagttatgtaggtgttcgtgattgttgtcgtttttcgtgtcgtcgttgtcgtcgtttcggttgtttagcgaggttaggttttcgcggaagcgtttgtagtcgtcgttcgtgttggatttgttcgcgtcgcgggtcggtttttcgttgttcgttgtttcgagggtcgagtttcgggatttcgtgttattcgcggtcgtcgagggggagggcgagggtagtggtcgtagtcggatgtttttgcggttggggttttggcggttttcggttttttttttttcggcgttttttttttcgtttatgatttacgttttggtttttatttgttgcgggaggttgtagagtcgtttgcgtatggacggcggtagtttgtttatggcgttaggggtcggggtcggatcgggtcgggggtaggagcgcggcgtcgcggacgggttttaggttcgttcgtcggttagttcgttcgtggggacgcgttttttgtcgtcggcgtgggggtagttttaggcgtttatgtttgggtaggttgcgcgtcgcggggaggattttagtttcgtttcgagttttcgggttcgtcgcgttatattttttttcgggttcggttgggcgcggggatttcgcgttttttttttgtttttttttttttttttggcgtttaggggcgcggcgcgtcgttcggttttaggcgtttcgttttcgcggggaataatgggcgtcggtcggagaggttttgcggtcgcggcgtttagggaatcgtttcggagtgtagagcgtacggttcgcgcgggtttcgggcgtgcgtttcgcgggagggttggttgttcgtttgtttcgtcgttcgggttttgtggttggttattcgcgagttcgtttcgttttttttgtttcggttcgttcggttcgtttcggggttttcgtcgtaatcgagcggagtttagcgattcgtcgggtttatattagcggtcgtttttttcgaagcgtttttcggtagcgttcgggttttcgcgtttcggaatatttatgaagtcgtcgtagttcgcgggttgttataggagcggttttagtagtcgggtttgtttatttgggttttttaaaggggtagcggcgtacgggtcgggggttggaaaggggcggggggcgggtttggtaaggggtttaggttagattttcgttagattttcggggtcggggtgagaggtatttatattgttgcgtttttaaattttttttttgggttaagttgggagtgcgttttaagtttgaagtttcggttttagttgcgaattttttattttaagattgaagggtggggggtggttttttaatttttttattattaagttttgggttcgtttttttttggtatttttgttttttagttgggttttcgattttttttttgggaggcgatcgggttcgtttggatgtagagtttcggttttttcgtaatttttttggagagggggttttcggaaatgcgtcgcgtcggggaggtttttacggtttttttgtgatatgggtagggtgcgaatttcgcgttagttttttttttgtaaagtttcgtagtagttaggtaaggagggcgtggggaaatagggagatacgtatagggcgcgcgggtgggatttagtttttcgaggtaagatttcgaggaaatgcgtcggtaatagtgacggatgcgagattcgaacgtcgattttcgtacgcgtttttttttcggtagtttcgagaaagggataagtcggttgtagcggggagcggttgggtcggtttttcggacg

SEQ ID NO: 11258 - DNA, 1441 bp, Artificial Sequence
  Description of Artificial Sequence: Synthetic polynucleotide
tcggagggaggaattatcgtaagcggagatttcgggcggcggtcggcggaagggttgggcgggaggcgtcgggatgtcggtaggattttgcgttcgagggggtagggggttcgtgtcggggttttaggcgtagattgatggggtttaagtagggaatgtgagggcggggagggcgtataacggaagggattaatttcgcggtttcgagttgggagtaaatttcgttttttattttttttattcgttttttttttttagtgaagacggtttgggggcgggtggggaggcgcgttttcggagcgttttcgcgtttttttttcgtttttcgcgcgcgatttatcgttttttttttttcgaggttagcgatggttcgggtgcgggcgaggagttgggagggcggttttcgacgtaggtgttagattcgttcggtagtgttcggcgcgttggttcggtttttagttttttcggtcgtcgtttttcgttcgtcgcgtcgcggcgttaggagggcggggtcggggcgcgcgtcgttttttagtaagcgggcgggcggcgttcggtttgagggagcggggcggttttcgtcggcgtcgcgcgcgttgtgtgtgagcggggtcgcgcgcgcgcgcggtaggcgagtgagggaacgaggagcggtcgggtgtgagtgtgtgggagtgagagtgtgtgggagtggggtgagggagaagttgacgggacgcgaggttgtgagaaattgggcgagtgtgcgaggacgttcggttagtttgcgggagtcgtagtcggcggaggagaaaggaggcggttttcggtatttcgattttttttttttttttttttttttttatttttagtcgttcggcggttcgcgttttttcgaaggttttagttcggtttagtcggtcgagagcgagggaggagtttttcgatttaggtgagcggtacgatcgttgttgttttcgggtgtagagtagtgaggcgaaggcgcgttttttcgagtgggcgagtttagcggaatggatttttcgattagcgggggttgggtcggggaggggatcggttcgagcgcgttcggggttcggggttagttgaggtcggtggtcgtcgtttcgcggagtcggtggggagcgaggcggggttcggttttcgcgcgtgtgtcgggaggcgtcggttcgtggcgtgtgcgtgcgatcgggcgagtcgtgtcgagggggcggcgatttcgggcgtgtaaggagtatggttttttcgtcggcgagggggtgtggtaatttcgggaacgtcggttggagtcggattcgcgggttgttgatttgttttcgggattgcggcgatatttttttttttttttttttttataaattttatggagcgatcgcgggaggaggattacgtggtgcggtttcgtagttattgtattcgattttacgtttttttttttacg

SEQ ID NO: 11259 - DNA, 734 bp, Artificial Sequence
  Description of Artificial Sequence: Synthetic polynucleotide
tcgattttgggtatatagcggtaaattttgtttcgtaatatcgtgtgggttttcgcgtattttttcgcgtgagcgtttcgagttcggtgtagtttcggttttcgcgcgtttttgtttttcgtatagcgttttcgtttcgaaggtgttttgataatttcgtaggcgttattcggagtcggggtagggtagttggggttggaggcggcgggcgcgggacggagttttatgaaagttggaagaagtgattataaatcgggattcgattttcgtagttttggcgttcgtttttttacgtaggttcgggatgtcggttttagtttttagatgtcgggaagacggcgtcggttagtttaaggaagagtttttaggaggttggggagtaagggtgtcgggttttttatgtcgggttaggttttttaggagtgtcggtttttagggttattaggtttaggtttgcgcgaggagggagcgcgcgtttttttttatttattcggttttcgtttttaattcgtttttcggtttatatttatttgtttggttgtaagcgtcgtttcgggttaggtagttaggtttttatttttagtgcggcgcgtttcgatgtcgttatcgggattttcgttttttaaattagttttttttttattcgtaatttcgttcgtcggggcgttcgggggcggaggcgcgagtcggtcggcgtcgcggagtcggttcgtagatagggcgggcggggttcg

SEQ ID NO: 11260 - DNA, 935 bp, Artificial Sequence
  Description of Artificial Sequence: Synthetic polynucleotide
gcgtgcgattcgcgtttattgtggtttcgttttattgatgatcgtgaatttgtagggtgttgggttagttttttattttaaggttgggtaggttttcggagtttttttcggtttagatagaagtttttttaggagcgggggaggggaagggggcgcgcggttcggttttaggtgtggtcgcggataatgagattttggggatgggggcgtatttgcgttacggcgtttcgtagagggttttttaggagattttttcgggttttcgtcgcgtcgtgggggtggggtagttttgttggttagagtcgggtacgggtcgggcgggcggcggggatcgtgatcgcggttgcgtgcgttcgcgttcgggcgtttttgtgcggggttttggtacgtcggcgggggcgattcgggtgtcggttcgtgcgggcgatacgcgcgtttttgcggggttgcgcggggttcggagcggttgggggttttttgtcgggcgcggttgggcgcggggggcgttttcggtcgggatgagtttatcgtagtcgcgtcggggttgagcgtcgagcggggcggcggcggggcgggcggcggtttttcggcggtttcgcggcgttcgggtcgcgcgtcgttatgttgggtttggacgcgtgcgagttgggggcgtagttgttggagttgtttcggttggcgttgtgcgttcgaggtgagcgggtcgggtaggggcggggggttcggttggttttagtttcgggcggggagtagtttttttttcgcggtaattttgggggcgcgtatggggatttcgcggcgtcgatttttcggttggggtttggtaggggtgggggattttatttaggttttagttttgtggggaagggattaggtgcggacgggtcggtttgggaagcggcggcgttgggattttttttttttggatatcgtcg

SEQ ID NO: 11261 - DNA, 1054 bp, Artificial Sequence
  Description of Artificial Sequence: Synthetic polynucleotide
gcgcggttttcggaggtcgatattataacgtttgtaagggtcggttggggtcggtatatgattcgattttacggtcgtttttaggggtggaggggtcgttattttaggtttggggaaggaatacgaggttttgaggagcgaatttgttttaggtgttcggggaggtttggcgcggggttgtttcggtttttttttagagtcggggagaggggatatcgtaggatgtcggcgttcgaggcggtagtattaggtttacgggcgttttagtttaaatatttttcgtgtttttagagcggggattttcgttttttagattcggaagcgtcgtttttttcgttagggacgtttgggttttcgtagatttcgtcggtcggcgcgttattcgcgttagtattatggatagcggtcgttttagtcgcgcgtttagggttaggttcgggttggtttttatcgcggacggttgcggggtcggggtagtttcgtaattttaaatttcggtagttttcgtttagtagggaggggtttcgggggcgaagagtgggggagaagtcgggaaggattcggaggaggcggcgggggcggcgttaggggaggaataatttcggcgtagtgtcgatttaggttgaaaacgtttttagttatgggtttgtacgtggagcgtcggggttgggggaggtattcgcggggtttttttttcgtttcgttcgggagtttacgtttgtcggcgtttatagtttcgtttttatttttaggttttagggtcgagatggagaaattaagtcgtattttgagagtttataggagggaggggataggttgaggagcggtcgtttgggtatgggttcggggtttggttttttttatttatattcgtagcgttgttagaaggcgttgttttgtttgtggttagttttcgattcgtgtgtttggtgggagttgtattttcgtataggtagttttattgttttttaatttcgcgtttacgtttttgtcggttttcgttgttttttatattttcggtttgattgatttagttcgaatattttttatttcg

SEQ ID NO: 11262 - DNA, 1474 bp, Artificial Sequence
  Description of Artificial Sequence: Synthetic polynucleotide
tcggacgttgtggtagaggaggttcgcgcgtcgtatatttgttgggatttttagttcgtttaggattggtagggagattttggaagattagcgttcggaggggtgaggtttcgttttgggggtaaggtcgcgaaattacggtttgtagttttacgttaggggtataaagaaaagcgtcgtcgggaatttaatatttgtagacgacgcgtagtcgtagaggaggcggggcgttcgaggtttcgtttcgtatgttaatgaagtatatattatatcgtttcgtttcggcgcgagatcggtttaacgttgcggagatttagaggtcggcggcgttcggaaatattcgcggaggtcgaggtagggcggggtcgggcgtcggggtcgggtcgttgggcgggcggtatagttcgggggaggttaacgggtcggtcgggcgtttcggggacgcgttttttttacggtgcgaagtggtacggttcgtaggggcggggtttaggttatgtgacgcggtcgcggtcgttattttgttttgcggtgttggtatttagagcgtagcggttgacgggtcggatcgttttcgtcgtcgttcgttcgtaaattttcgtgttcggttcgttttcgttttcgttttcgttatcgtttcggtttgtagagtttgttttttttttattcgtagatatgttcgagtttaagagcggtttcgagtatgtttcgtttttcgtcgttatgggcgtttcggtcgttatggtttttagcggtgagcgcggcggcgggagggattcgggggcgggggcgcgcgcgttgtttatgttcgtagttcgtcggggttcggtgtgtgacgttattttgacgtaatttcgagttgtcgggggcgttcgggtttcgtgtgatagcgggcgggggtcggcgtttcgagggttgcggggagtcgtcgggggttcggggcgtagggcgtgcgggtttggtcggggtgtgagtttcgggggttcgggtcggcggttttgttagtcgggtcgtgcggttgcgggggtggggcggcggcgtcgttgttatattagtttcgggagcggcgagagggaggttggggtgggggcgcgaggggggcggcgcgaggggggtcgattttgcgggtaggtgatattatatttcgaaggttttagtgcgcgggcggcggcgcgggttcggtttaggaacgtttagtcggtcgttggagtttttcggttggtggggagtttatgttttttacgggaggtttttagttttcgtttttatggcggtcggtttcgagggttaggtgggttttatttataggtaggtattttcggttggagttggttatagttgtttaatattcgtgtcgttgtgtgggttgtttgggaaagttgggttgagggtttggttcggagagttcgcggagattcgggtgggagtgtgtggaagtggagggagcggggagatagtagtatcggcgttggcg

SEQ ID NO: 11263 - DNA, 357 bp, Artificial Sequence
  Description of Artificial Sequence: Synthetic polynucleotide
tcggagaatttcgtatatatacgtattcgtaaatacgcgggttttttgcgttattaggaagtagtcgttagaatcgtcgggtgttttttaattatttttgggagatttggtttttcgttttcgttcgcgcgcgcggttacggcgtttttttttttttcgggtttttaaggtcggattatcggtttcgttgttatggcgacgtcggtttatttttttttattttcgcgcgtttttacgtttttttttcgtagggagttggggtttttttttttttttttttacgttcgtagggatttataggttgataggagtagggggtcgtttgttgttatcggtcggggatttcggggtttttcg

SEQ ID NO: 11264 - DNA, 814 bp, Artificial Sequence
  Description of Artificial Sequence: Synthetic polynucleotide
tcgtcgggagtttcggggttcggttttagtttcgggttgaataagtagggaggggagaggtatttaggtttcgttttttcgcggttttttttttttagtcggggaggaggagatttaggaagtcgcgttcggtttcggtgggtggagggtttaggtcgcgttttttagtttcgcggttttaggtttcggttcgttcgaggcggagttcgggaggtcggggcggggtttcgggtcggttatttatttgggttgttagttattttagtttcgcgaatagttggtgtcgtcgttgtttagtcgagatttcggggttttgcggtttattatttttttcgatacgatatggttaagcgtcgtcgttcgaatcggtcgtcgtcgatatttcgtttcggttcggggttgaggaggaagtcgagaaggaggaggaggaggcggcggcggagggcgggggaagaggacggtcgtttcgggtttcgtttgagttcgtagggtaggacgagggagcggcgcggtgagagaggcggatgaaggcgaggcgacgttttttttagggtcgtgcgcggtttacgacgttggggtttcggaggacgaggaggacgaggagtaggcggtggcggtagttttttacgtttatacggttattgttttttcgtttttcggtttcgttcgtcgcgtcgtcgttgtcgtacggtaagttgggagcgagaggcggggtcggtttcgtcgggtttggggagagaggcgggttttgtcggcggggcggggtcgatagtaggtagtttcgttttttacggttttaggtttttggacggcg

SEQ ID NO: 11265 - DNA, 847 bp, Artificial Sequence
  Description of Artificial Sequence: Synthetic polynucleotide
acgtaaagcgtttttttttttattttcggagatggtacgtgcgcgtttttacgtagtggcggttgttgcggcgagtacgttttttgcgggatttacgcggggagtgggttggtagtgcgcgtatagcggcggcgagtgggtcgtgtacgcggatgcggggtgggagtgggggcgtacgcgcgggcgtgggcgagcgggtttcggtagtgtatatatacggtaggggcgggcgatagatgtagtgcgtgcgtcggagtttaagcgtataaacggaaagagcgggcgcggtgcgtaggggcgggcgtttagcgggtttggtatgcgcgttttcgttcgaggttataaaagtatcgttatttgttgttattagttaagtcgcgcgtttagttgtttggagaagttcgtttatcgtttttagttgttgtttttttcgatatggattttgagatttgtttttgtttttttggtgagttttcgttttcgttcgtattttgcgtattgcgcgtttttgtatttgtaaagaaatttacgttttgcgttttcgtttaaggatatttgggggaagggtttttgattttttattttttatttcgtgaagggcgggtatgtttgtgtcgcggagaatagggagatttggtattttattttttcgtgataggcgtggggattcgagttcgtttatattaattttttttgtggcgtcgttttttttaggtggtttttgtatttgcgcggatttttgtaagtgcgagggatgtaaatgtattttttgtaagaagagtgagtgcggggattttttttttttgtcgtcgttttttttgttttgcggagtcggtgttttattacg

SEQ ID NO: 11266 - DNA, 589 bp, Artificial Sequence
  Description of Artificial Sequence: Synthetic polynucleotide
acgggggtaggcgtggcgtttttgggattgtcggaaaacgacgtgagggaaaaatttagaggttacgaaaaggcgaatagacggagggtttgttttaggggagttaagtagttcgtttgaagttttttatttggaaatgacgtgtttaattcggcgtttttgtagtttcggtcgtttttttttgtttaatttcgcgtttttttagtttcggtcgtttttttcgtcgtttttttttcgcggtcgtttatttttgagatttttggttttattgagacgtttagttttattcggtaattcgcggatattaagcgttataaatttaaatacgagatttagagacgttgggttttaaacgttttttagagtgaaagatagaggaattaatcgaggttcggttgattttagacgtttaaggcgataggcgttgttaagaaaagggggtgggacgatatttagttgttaagacgacggttttcgggtgggcggtttgaggtggttttcggtcgttaggcgagatttcgcgggaaaattttttgttagagagattaggagatttggggttgcggtcgtttttttcggagtatttacg

SEQ ID NO: 11267 - DNA, 848 bp, Artificial Sequence
  Description of Artificial Sequence: Synthetic polynucleotide
ygyggygtattttttttttygtattatatatatatatatataygatgatatatatttttgtgtttttttygatgtaagtggtttygtttttygttgggttttaggtgtttttgtaggaaatgyggaggygyggggagtttagggaaygggtttggggttttaagttygtgatttttatttttatttygggttttagttttgyggygtyggttygtagyggatttatyggaygatgtygaatatgataagtaygttgtttagtagttttayggygtatayggtygagtagagygyggtgatggygattgttagggygagggaygaggygtttygygygtttggyggtttygaygtattggygttagygttggggtaggygttagggtaggygttygaggygttggygaagagygggggttgtagttyggygtyggyggagggggtyggttttatggttgtyggtyggtttygtygygtttttttttatygtgygttttgggygyggggattygaygygaggggagyggtaaggtagaggtygyggtttygaygtygtyggttgtygygtttyggtygtttygttgtttttgygtttygttygtttgtttygtygttygtatyggtttagttttyggygttygttygtttttttygttyggagygttgtgagttaggagtagtygtaggtttttyggaygygttygtygygygtattaygtggttyggaggyggtygttagtttgygttygygatygggggyggaygttgtattatyggttyggagttgggtaggggaggtttttygttttttttttagggatgtttygtyggttygagtgygatttygt

SEQ ID NO: 11268 - DNA, 1230 bp, Artificial Sequence
  Description of Artificial Sequence: Synthetic polynucleotide
ygyggttygtattttttttgtttygygggygttttgygattttttttattgygttyggtttygatagaagtttagggagtagtggttttygygtttygtaygttagaygtggggttaggyggtaggtttttagtttaggaatyggggagttttttyggaagggtgtgttattyggagttagyggttttttaygtatttttttagagtgagaaygtaygyggygtagttatyggttygttttttttatygggggttttyggatttttaatttgtttggggttgtttttgtttttygggygaggggtttttggggatttaggatatttggttayggggaggyggggtatggggggtagaaagttagatggagygggtaggagaaggggggtgttgggaggagttaaggagggagagagggggygtgtatggggygyggagttaagagttatygagtttgggygyggtgtgtaggygagggttayggttttygtagtagyggggaaygyggggagtygaggtatttagygggtyggggaagaaggtgggggatttygyggaygtygaggagagggtattgyggagttagtaggttttgtagggagtyggagaggggttgagtagattttgaaggygggygggggaygtatttttyggyggggtagggtgttttyggatayggygagygygyggtatagttyggtagggtgatagttttttagygtygygtatagttygttygttgggggtttaggggtggyggttgyggtagggggtttyggggtygggatyggagyggygggygygattttygagtygggagttygggyggyggggttyggggtggtygtygttttttttttttgttgtagttttttgagtyggyggagggttatggtttyggygtyggaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygt

SEQ ID NO: 11269 - DNA, 1094 bp, Artificial Sequence
  Description of Artificial Sequence: Synthetic polynucleotide
ygygggagtttttygagttttattggttttttttttyggtygtygttaygyggggygtygygtttttaygggtttagaygtttagttaatttttyggttttgtaaaagtttttgggggtgygyggggttgggygggggtgyggygtggttttttttagggtgggttttaaagtttttattttygttyggggygttgatatygtygattygtaagtttatgtygygttyggagygtygyggggttagtaygttygggygggyggttyggaggaggyggyggtayggttggggtattttyggtttygattygygatgaatggggyggttygggtttygtttttygtagtttygttyggaggtttygtttttygagtttttygtttygyggttttygttagtaygttgttygggygttttttaaattgtttayggagtyggatttygygttgttaaygtttygtttygggtaaggttgyggttttygtygggtttyggygttygttgtttygtaygttygggttygggaggaggaggtygggggagtygggtygggygtygygagygttgggagggttyggtttygtyggggagyggttttygagggygtaggagygggagtygggtyggagattttygygtagttyggtgatattttygtttygygttttagttyggggtttttaggtatygygygygtttaggyggygtattygtatttattttygtttygaggttygtttygttygttaygtyggtygtygttaaygagttttyggttygygtygttttagygttttgtagyggaggygtygtttttatttygatygtaggttygttygggtygttygttygtygggtatygagtygttttgtygygygttgygtttyggggyggggtgggaggagagggagtagtygttattttgtttaggtygtygygggttagttttgtagttagttttagttttgggtygggtgttgggaaggtyggaygtyggtyggyggtygyggggtttgtttttyggaggttggggyggtttaggttatagatttygtygttttygtattttttttttagttatttttagygtygt

SEQ ID NO: 11270 - DNA, 1979 bp, Artificial Sequence
  Description of Artificial Sequence: Synthetic polynucleotide
ygtttatttttttygygtgttggagaattaattagtaaggtagggaatgyggttygtgggygtttggtttttttaagyggtttaggtttttagagygygaggtttaggggttttggagtygyggtygygaygygttygagggtygtttttttygayggtagagtaagagttatygygygggagtttygagygatygtttygttgtttyggtatttttttttygtagtygtttagagttttttatgtttygtgaygttygttagggtagygyggtyggaggtygggtyggaygtggttygagatgttygggggtaggtagaagattaygggtaygygataggtaatygtygtttyggttttagaggtggaygttttgtttttttgygttttaatattagattttgtttttagaygatatttttgttgttttyggtatttggaaagattaatygttaggttygagaatgtaagatttatttttttttgygayggaggtagttaatttagttgttygttatttttagtgtygtatgygtttttaygtaggattttgtttaatygttatygggaygtttttttagtttygttttyggatygttagagaggttgttaatttygttttttttttttattttattagygtattaatttayggygttgtgaygtgtatagtttttgyggtyggtyggggygggttaatggyggtggyggatayggygggttaatgggygggagygttttatgyggtyggttttygtygtagtygtygttgggttttggagttagaggtygttttgagayggtgygygatggatygagggttttagtyggggaggygtygtygtygagttygyggttagaygttttattagtagygttygtatygggagtygyggttttygttygagtygtgggygygttygaggggygggttygtttttygtygtttttygtagttttgtygggttygagttygygtygtygtygtygtygttttgtygttygggtygygyggttygggaaaygyggtygygggttgtatgggtagygttygygtttygtygttgagtygtygyggagtygygtagttttyggagtayggtgagaggygtygttggtttgggggyggtggtyggggygggtayggggtattygygyggttttgyggtttgtaggtttttttyggygayggagttgygtygygggttttygggygggtttggggggtyggggtygggtgggygggggtttttgggggttyggggygatygtgagggattaataatgggtttyggagygggtttaygggttygggttyggggtagtygggggtttttgggggttyggggtggtygtgaggggtttatagggggtttyggggggggtttgggaggtyggyggagtttgggtyggtygtaaggggyggaygggggtttygggygggtttgggtggtygggggttygyggyggttttgaggggtygattgggggtttyggggygggtttgggggtygtgggggttyggggyggtygtgagaggyggatagggggtttyggggygggtttygggggttyggagyggtygtgaggggyggayggggggtttyggggygggtttgtaggttttggggatttgaggttgtygggaggggttgttagggggygttggtygggygtygggttttgyggagttggggygtygatttttgattygygagaggggygttttygtygtgttggtygtagttgttatttttagygtttttattattatygttgttttgaaatgagagtaggyggttttygggtttygagtyggagggggagggygaattggggatttgggggygtyggggttgtaggaggygygygtaggtygaggaggggtaggaatgygggtagtygtgtggggggtgttagggggagggtaggygggygggtgtggggggtggttgggaggaaagyggtggyggtggygg

SEQ ID NO: 11271 - DNA, 1930 bp, Artificial Sequence
  Description of Artificial Sequence: Synthetic polynucleotide
ygyggggagatyggggygygyggtaygyggygtttttatttgtggatgtttatttttygtggagggyggtgggttttgtygtaggagattttggygaagaygtyggttaygatgaygaaggygattatttygtaggtgatgtagayggtgaagttggttttgttttttttygggtygtatttgttttygggtttyggygatattattttggtgttgggygtttgtatttatatygggttttggtagttggtgtattggygttggtttagtttttygtggygttttttgtagtagaagyggtagtagtaggtatygtagtagtataggtagtygttttygttgttgttatattygaattttttgtygtattggtygtttaygtygtagtagttttagtaygtttygtaggtgayggtygygttggtygtygtygttatagtygtygygggttgttttygtyggtttttygttttygggatttygggygttygggyggtgtygtttagttygyggtygtttygtgttagggygttttyggtttttyggttttygayggtagygtygtttgtatttagggttyggttggyggygyggtygygggtttygtggaygttgggtagtaggtttagggattttagygagagtagtagtagtagtaggaggygtygtagygttatggyggggtygggygggagggygyggggaggttttygyggtaggtygttttttyggygggtygggttyggaggattygtygygygggtygggttggaggygttgagyggttagyggtttyggggygatggygttatygaggygygggyggtagtggyggyggyggygygyggtgygtayggatyggttyggygygggttgttygggtttttaggttgygygtyggtttygygttttttttgygggttyggygygttttttgggtagttttatttttygtyggyggtgattgyggtttygygygyggttyggtttaggtaggattygaagygyggtttygggyggyggyggyggyggyggyggygtggtttygttygggygggttttgygggataagayggggagtyggttayggggtggggygattggygtttygggagtaggaggagaatygygggtaggygggyggggagggtgygygtagttttygaggagagagattyggagtygggaggggygtagagttygtttttaagayggggtttygyggttttgygygtttggaatygagagygtaygggtygtttttttaggygtagttyggtygttygggttttttagtygttyggtttygtagygygttttygtygtaggttggttttttgggayggagtyggttgaggttggggttyggyggygagtygggagagygygyggyggttggattttatttatttattatgttyggttgygattgtagaggyggyggyggyggyggyggyggyggyggyggggygaggygggaaygtagttgtyggagygagygagyggagagtygtyggttygtygtttgtattagtgtyggaaygtgtgygagagtgagygagggagatataygtatttatatattygtatataygggagygtygygaggggaggggggataggggaggggagggtagtygtttttygttatttaygtttgtaygttygggygtttagggtgyggggygggggggattttttttygtttttttyggatygtagtagttgaagtttygygttaygaaagtttyggatagtagttattygatayggygaattyggygggygaagagggggtygggagtagggyggaaygttygttttgtagtyggttygyggtagggattgattttttttgttattgttttttttagttttygygattagtttttattttatyggagttyggggtagygygttgtttgagygg

SEQ ID NO: 11272 - DNA, 3177 bp, Artificial Sequence
  Description of Artificial Sequence: Synthetic polynucleotide
ygtaggtggggtaagttygggttatygaygagatttgttygygttttygtttttattttggtgtttttttttttttttggtagttttttttttattygtttatttttygggtttatttygatttatttggyggtgggtttttttttttttygattttyggyggtgyggttygttttttttttgatttygygtttggtygtygtgtttygaaggatatgggttatagatygtgyggagatattagtttygygggyggttgttttggtttaagtagaagaaaattatyggggttagygtygggtayggtagttttttygtttyggagttygygttgttygggtttttttttgttgatttyggtttyggtyggttttyggttttygataggtygttgagtygtatgaagtttyggggttgtttygatttttyggygttygttttattttttttttygtttattttttggttagtyggggtttygggygattyggagaggggtaagyggygttttttagaggaggtgtttttaygtaattygggggtttyggygggggtatatttggtgggttttagggygtaagttgagttttygggagggttagtttagtttagttttttttgttygtaggggtatgttgttygyggggygtyggggygtagggaaatttygttyggygygagtttygttttttttgygtttttggggtttttygggttagtyggtyggtttttttttattttgtttyggttttttygtttygygtttaggtttyggttgtyggattyggygttattttyggygaagtygtttygagagggygaaygaaaaggggggtagyggyggagggygggggttyggggaggggygtttttttttttygyggygtagttggagtyggatttaaggggttagtatygtttyggtttygygttaggyggygggggaggggaggagggatttttttaggggtgggtttggagggggtgggggyggttttttttttygtttygtygygggtttattgttygggaggggyggggagatagtggggggtagtttygggygggagtggaggyggagatgtygtygtygtagtygtygyggtggttgtygttgtygtagttgtygtyggygttatagttttttttttyggtygagaygyggagygagygagygaaagyggyggygaggagtttygygtatattatagttggattttttattttaattttaagtttyggtttygtttttagatagtttygtagttaatygtyggaygtygtyggtttygagtygygygtttattggtygttygtygtggtagtgygggygggagygtagggagagaattatagttggaattygatttttattttaaaatttaggatygttttttttttttttttttgtttttgggttygttttygaaggttggagttaattagattgttgtttagatygaatttatttttttattggttattggggtttttgggatttttttggagggagttygaagaattagagtattyggygyggggttttggygtagggtygtaggttttaggtattttttgtttaygatttttgatttgggtagtagtyggaggayggagtttagttttgggygggtttggggaagaaaggagataggyggtaygggggtgagggttgttattagggggttttagagygaaattttaggtttttatttggttaattttttattttggagttgagtttggttgygggattgggggagggaaggagyggagttggatgttttgggggtggggttttaggttggaggggtttagttttggagaaaygggyggagttygagaaaggttagggtaggtatggtttgggygtggtttttataaattttttgggtttattggttatattttygagttaattttgagatttygattttgatttygtaattttaattygttggatttgattttatattgaygtttttgggttttatttttttgtttttagggattttttgaagggygtggattttaygtaggggtttygtgtttgaataygtggttttaggtaggtygygttggatygtagagttyggatttttaggaggggttgyggagtagagygaggatttttaagaaggaatttgtgggggtttygagtgtgtgggagggggyggaagtatagagttgggttttatygattygatttttaaagtttttattatygttattttttaatttygtgttttagttttttttaagtttttatgtggtttagggaaagagtgttygyggaattggaatttygygggtttgtygtttttatttatttattttaattttatyggtagygggttttygtgggtttgtgttttttaygygtgtataygtaygygtagatttyggtttttgtttygtttattttttygagttttggggtttagtyggttttagtttttttttgtygtyggygttattttagaaagttgtgggtattygggagyggagygtygygggtgtgttgggygtyggtggaggggggaatagygaggattagaygtygggaagtatttttttaatatttgygagaggtagatayggyggaatttagtgggttagttagtttttttttyggagattttggggygtttgygttattgyggagaggyggygggatgggtyggatgatttttattattattttttattttgttgaggttattatttttgggygttgtttatttttttaaggttgtattatttaygtagttttygygtatttttygttatygtagagggttggggtygttttagttttygtttyggtygatggggggaggggatgggggaagtggtagagtggttgttgygtygtygtttttttggttgttttttygtygaatttatgtatagagttgtgtaaatgaggtygggygggtttatttgtattttatgttaatgagtagattttttaagtgttttttttttttggygggagtttttgtttttattttgagtatgyggygtttgagttttgaatttygtgtygttttttgggaaaggggggttatttatggttgtttygygygtttgatatttttttttttttygagaggtygtagtttgtygggtyggtttgtttttttygttaggatagaggtttyggggttggygyga

SEQ ID NO: 11273 - DNA, 2195 bp, Artificial Sequence
  Description of Artificial Sequence: Synthetic polynucleotide
yggtagagaggaygttatttaygagagagagtgatygyggatttttatygagaggtaggyggtggaggggttttttttggagatttygattatggagtggttttttttttttttagttygagtygtagygtygggtttttttatttttttagtttttagtyggttygggtttgaaaatttttagygatygagyggagttggygyggygtttttagttygtaggatgtttagttttttygtttttgttttygtttatttttygtygtttygattygattttttygggyggyggagygggaaggtagtagtttttatttgggattygtygtyggtttygttttagygtagygtttggggttaattttagttttaggyggggggygggygggggtgggagggaygyggygyggggygttgggttaggttyggttttggttgggatggyggggttygggtygggaygtagggtttgtttttttttgggatygaggttgagttaggygygttgggttgttygttttygygygggtttgtttttaggtagggttttttgttttyggygagggtgggttggagtttgtattatygttatattatttttatttagggygttaatygggygttygtygygttttaggtaygtgygtttygtttatataggaataaagtttgttyggtttttttygtttygatttatttttaggttgagtygattygtatttttyggttggtgagggagatgggagtttttggttttgtyggygtgtgggttgttgttgttgattgttaygttttygtatgygggygygygtatatttaygygtatttattttttgggttyggttttygtyggggtaattggtgtgagggtgtagttttgygtattttttatygygttttttagagagygygtttayggataygygyggggttattttggygygttttygtgggggatatttagtttttgttattttygttttggttttttygtgagatatattttaggtatagttygttgggagygggtyggagygaggygtatatttaagatagagttygtttttgttaygttttttgygtttttttttttttttagtttgtataygtggatatatygtatatygaggttygttttttgtaygtayggtttttttttgggatttttattagttattaagygtaygtgggatygttattaagygttttttttaygygtgggtygagtttagattattttggatygtgggtaaaggtttttttyggttygattatttygygttygggttttttgtgatygttttaggttttgtttaattyggagygygtttttttttttyggygttttygttttttgtttygatttgttttaattagtttttayggttttgtttttygaggtatagtgtttagygygattttttgggtttttgygtttygggataygttggttttgatttygagttygttttttttaggaggttaggtttttattagttttattttttattttttgtttyggggtggatttgtgggttgttattttttttttttyggttttaggaatttgttgaagttggatygtagaaattgggaagygaatttaggttggtatttatttagttygataaataagagatttttyggtygttttttttyggggttgttggtttygyggggggtggggtgygtagttttgggggttygtagygaggtttagttagttygygttagaggttygtaggggttgaggygtatagaggagggagaggttgttgggtttggttagggttttggagaygyggagggagggtagggygtygagtttyggggtgtyggtttttatgaygtygaattgtttgggggatygttagyggtgygtyggtyggagttagttggtggyggggygggyggttyggagtgtttgtttaattttgagygttygygagggggaggggaggtagttggttaygggttagggggtagtaaggtggaggagygggggttgggaaaggggagggtatttttygggttgtttgtttgygtgtttgtygyggtttaygataatygggagtttaaattttatgaattattyggagttgttggagygataaattttaggttggttttttttttygtatatyggtttttyggatttttggagggaatgtttgtttagyggtyggagttggygg

SEQ ID NO: 11274 - DNA, 2063 bp, Artificial Sequence
  Description of Artificial Sequence: Synthetic polynucleotide
ygtttaaagtagaggyggtaattaggygttygggttaygttatttgataataggatagatgttgtayggttygttttttttataygtattatttygtagttygtagtatygttagaaaatttatttgattttagagtygtagagygtttaggggttttttttygtttattygtagtaygtttygggtttttttttttttttaaataayggtatygggtttttgtattaaaatayggygggttygygtttgttattattagtgtaaaatttgyggggggttgttyggaaaggatygaattttatygttgtatgagttttaaaagggagggggtatatttatttttagttttttattttattttygtttgattgtgatgtatatygggygtttgtatagtttygttttatattagtatataygygtttyggtttyggtygtttttygtygttttttttaaattyggtyggttyggggtttggygtygtaygygggtygttaggggttagygttygtttyggttyggttyggtygaataaagggttygygaatttttyggtaaagttgyggttgyggygaggagygggyggattgtygygtttatttgggtttygttttyggyggyggyggyggtttygyggggtttyggtggygygggtttggyggyggyggyggtaygaataatygttygagggtttygggagtgygygggyggygggggttygtttagygtyggygttayggatttaggtttyggygygggyggyggyggyggttgyggyggyggygygggygagtgggyggyggygygtttyggtaggtttaggttyggtttyggtaaygtygygaygygtttttttttttaygttyggygggatgyggtttyggyggggttygggttttaggyggyggyggyggyggyggtggtagttgyggayggttgggygyggggtygtttygtttttttygttttyggttygggygggtttgyggttattgygayggtgayggyggygggagygyggygggygttgggattgttttgttagggggyggttygggyggygtttaagattgygyggyggyggggtyggyggyggyggttayggttttyggggtygtygygttgaggtgyggagttgttatygyggttattttgttgttttaattgataagaattttttttttttygttttagttagayggggygttygygttttttttttygtttygygttggtttttaataggaagtygtttyggtttttagtaygtgatttttatygtatttgtatatyggagggygaattggttaatyggtattttgtatttgagtttttttttygygygtttttttyggtttattggtttttyggttaggttaygtttttttttttttttttaatattygttygygttgtggttttttgtatygygyggggagygygtyggggtgygagyggtgygygtttygagtggtygggaygygygttagttttgggagtttgtattgttygggggggttaygtggagatttgygtggtgttttttatygtygtygtttgtttttyggtttttgggygttgtggtttygygttagggtgttggygggaggggtgtygattyggttttgygygttyggtgggtttttygggttagygtttygyggygttygggttttatgttgtaattgygttyggyggygttyggygttygtatyggygygygtttygttygtgtygtgtataygttttgtatygttttattttgtataygtataygtataygagtttttggggttttggagtatygtgttygtttygygtttttyggttygtttttgygtttagtygttttttagggagygtttagttgygagtaaaataagtttygttgygaaatagtttttyggggagatagtttttttttyggagtatagatattatatttttatygygtaagttttyggttygggtygaattygggygtttyggygtttaygtattttaygattttttttyggtgtttygtaygtygtygtgattttttattttayggtttttyga

SEQ ID NO: 11275 - DNA, 816 bp, Artificial Sequence
  Description of Artificial Sequence: Synthetic polynucleotide
ygtagtaaagagtttygggygttttgggggagagyggttttaagtttyggaaagtgggtagagtttttttttttagggttgagayggtaggygyggggtttttttyggattygtttygttaaggggatagtgtaggtygtgtygygatttagattygaygttttygygggtttygyggygttygggttgttttygtyggttgggagygttygagtggttttygggaatttatygtgaagtaggagggtygggaataggtatttgagtaggaggyggygyggttaggatatttttagttttgttttggggtttttygtaygtygygtttygatttggtgttygggtaattgggygygygttttgtttttygttttyggtygggtgyggtygggttaggtyggggttttaggyggttgtygygygttttatgttyggygggttaggygyggggttgyggggygygygttttttgggygtygtygggyggttgtgggygtttyggttyggttygygtttyggtttttttgtygttygtttygattttttygygttyggtttygygtttygtttyggtygtygtgtgygtygttttgagttgtagtggtygttatygttatygtagttgtagygtttttttatatttttagygygtygtyggtygggtagtttggtygyggtayggaggaggggttttggagggggyggtygggggaggygaygtygagttatygttttygggtagtygtygtygggggggagygyggagatttgaaagggygygtygggtaaygttttttttttttttatttygggygt

SEQ ID NO: 11276 - DNA, 368 bp, Artificial Sequence
  Description of Artificial Sequence: Synthetic polynucleotide
ygtgtygtttgygttygtgggttatatatattttttttttttttattgttttttgggyggtgtggattagttgtagagtgtgatttgyggttagggagtgttttttyggagttttygtttttagatttttggtgttaaagaygttttgtgagygggtggggtygggygttttagttayggyggtygtygtttttttttttygtaggaygggatagygtttttgtggatygygttttagatgggttatagygaggtggtgygggtgatgttgttgygyggagtygatygygaygttgygyggaaygtgagtgttygagtygygyggttaaagagygaagtttttyggygygtttgtgtggagaaaaygg

SEQ ID NO: 11277 - DNA, 1411 bp, Artificial Sequence
  Description of Artificial Sequence: Synthetic polynucleotide
ygtttttygygtttttttygygygyggtttttggagtttttgaggygygyggttagtttagttygggttygtagtatygggagtagttygtyggttaagygagygygggtyggggtyggggtyggggtttgggggygtygttttygggagtttttttgyggtttttgaggagygagggygayggygaggttgatyggggtygaaattatgaatygaagtttttataagttttagattttgygattttaygattgtagygtagtggaagttaagagtaaggtaagtttttygttygtttyggyggttttgygtttagttttttggttaatgaatggggygtttygyggagggggattggggyggygtggaggygataggygtyggygataattttttagttygggygtygygygtygtttygygggaygygtattggggatttyggtygtttttttygtttttygygyggatataaagttyggtagtygyggygtttagagggtygagggttatyggatagttygggtagattttggattygtttygygggagttgtttttttgttttaygagtgagaggygatyggggygygttatatattggaggggagggyggttttttyggggygagttgagggttaggggttgttyggattyggggtygtgggggggttttgggggttygggtygtgggatggttttggttaaggygtttttaaggttgtaaaggaggtttgttatttgttaggaggagatttgtygtyggtttygagttyggygttttttattygttyggtattaaatatttaggtattaggygygttttttygygtagatttagagtaygtattyggttttttttyggtttagatttagattaygttttttygggygygttttygggttagatattttattttatttttaygggygygtttttattttagatttttttattttyggaygygttttygttttagatttagtttattttttygggygygttttyggtttagatttagatttttttygagygygttttyggattagattygtatttagattatttttaygggygtgttyggtttttttygttgtttgygttygggyggagygtgttygaatttgygggtygygatgygygtttgggtaattggttggtaggatttggygtttttgttttttgygggggtggttttttygtygtagatgttattgtttgtgagggtttttttggtggatttygygggttgaggaggtgttgtagttgttyggggttttgygggagggggtttttygagtttttygttggttattttttgggagttgagyggttttttygtttttttttttttygtatttyggtttttagagttgtgggaaaggtttttaayggyggagtgggagttygt

SEQ ID NO: 11278 - DNA, 1487 bp, Artificial Sequence
  Description of Artificial Sequence: Synthetic polynucleotide
ygggttttgygattygyggyggaggygtatagtaggygtttaaaygatygtgggtttagggtttygygttagygttttyggggttttttggagagaggtagggtttygtygtttyggttttygtaggaattagttggagaaaggygggyggtttggggttgaattttttttattttttatttttttygtygtttggagtagataygtygtygtygygtttttgggaayggttagggaagtaagtagaagtygggaagtygygaaagaggygagaaagtgygattttttttttagattttyggtttttygtygaaatttttgtyggtyggttaaattttagataatggaagttttaygtttttatttttatttttttttataagttyggtygygggtttttttyggttygggatttyggygttagtttyggagtyggagtttgtaygataygttttttttygtygttttatttttttattyggagatygtttatttttttygttttatttttttatttttygtttggtyggtttygttygattyggaggyggygtttttttttttgttttaggtttaggaaggaggayggyggaggaagtagggggttttggttgygggygtagggatgtgggtyggygatyggygttygagggygtaaaaaggyggttygaggattgygygygggygggtagygygggaagtygggaagaaaggagggygygygggggaggaggttgygggtgyggggttygaggtyggggygtttattttttygygtygttygygttygtygtttagttttygttgtaggttttgygygyggtttttygtttygttygtttgttgttgtagggtttggattttgygttttatygtttttagggagttgaggtyggttatggygyggaggygtagaggygtaygggtagyggyggaygttyggttgggttyggtttyggygagagttgtatagtygygtttyggttttttaagtttttgtttgygygggggtygttttygttttttttygtttttygggtyggttgtygtyggggygatgaggttattyggtyggatygtygaygttagtatygttgggggagggtttgaygtyggtatygttggttatagttgttggaaagtgttttttttygggatttatttggagaaagygttgggaggygtygttttttttttttttttttttttttttttttgyggtttttttygttttttyggtttyggggtttyggtttggtttygtygygggttttygtatttttgtataygtaygtyggaggttttttttttygtgagttttagttttttttgygygttttttaggttttyggaatatttatttagttygttttttgttttttttagttttttttggaggtgygttagttttttttttatttggggaygatagagygaggaaygggttagtttggggggggggttaygttttygaggtgtaggggygg

SEQ ID NO: 11279 - DNA, 602 bp, Artificial Sequence
  Description of Artificial Sequence: Synthetic polynucleotide
ygygtatygttgttgtattttttttaaygtattygtaattttttttaaygtattygtattttttttaaygtatttatattttttttaaggtattygtattttttttaagttattygtattatttttttttttattttatgygaagattgtagtttygtagttttgygattagyggtyggaagtagttaagatgttattgtttttagtatgtttygygaggygygtatagtataggtttttttttaaggttattatttttattttygttgtatgttgggattgtagttyggtygttttgtgattaayggttggaatygtttaagatattattttagttagtatggtyggtaggagygtatygygttgtttttttttagggattygtatygttttataattttgttttgtgttgagattgtagttttgtaggygtataattaataagttgggtgtagataagagattatagtttttygtattttaagtaaaggttttttttttayggagtttttttaygygtttattgyggtttygtygtgttaaggggagtttggttgtttaygggttttatttgttagygagaagatagtttggtygggygg

SEQ ID NO: 11280 - DNA, 628 bp, Artificial Sequence
  Description of Artificial Sequence: Synthetic polynucleotide
ygttttatygagaatagaaagtgygttttaggtattattyggatttygttaaattatattatttagaaggtagtgttataagggayggaagtygattttaagttatagayggaaggygtagaggggygttttygtagyggygtgggygggattttyggygtttagttttygttygtygttaggttgyggttgttgtggttgttaaygttatattgggtagaaygttagataggggttatttttygagatygagtagagayggatagtgaggaggataggatttatttataygtttttatgttagtygygattttatttttataagygtttgtaaaattttttttggggttttggygatagttttgtgtttttayggygygtagaggyggygtygygaattttgtgtgtattttataygayggyggggattgaggtttttygtagtttagagtyggagttyggggtyggtygagttygtaggatyggttttttygtygatttttayggttttatttagttttttgggtttatggyggygtyggygttggtgagtggagggtttygtagttygygygagttygggttatygttygtatgtatttattygttgtaatayggyggatgtygg

SEQ ID NO: 11281 - DNA, 215 bp, Artificial Sequence
  Description of Artificial Sequence: Synthetic polynucleotide
yggttgygtattgatygtatttgttatgttttattttttttaatygaagttgaaggtyggtttygatgtttgttattttttataattttatygtagtygatagttttataaatattatygttygtttagttttygttttttygggtyggttgttatttygygttttyggtttggttttggtttygtyggttgtattgtayggttygttttttygt

SEQ ID NO: 11282 - DNA, 2638 bp, Artificial Sequence; identical to SEQ ID NO: 6771
  Description of Artificial Sequence: Synthetic polynucleotide

SEQ ID NO: 11283 - DNA, 2172 bp, Artificial Sequence
  Description of Artificial Sequence: Synthetic polynucleotide
ygygtaggttgtgtaygtgtttgtgtgtaygtgtttttyggtgtgtgttttagttttagtgtgttggygygtgttygagtatagatatatygggggtgtttgggtattygtatatggttgygggtggggygtagtggagaggaagtttatatatgygtgtgttgagatatggtygtatttttgtgtttttttagtttagaygtaggggagattagtatygagatattygagttygggagttttttagyggyggtygggyggagtttggttttaygtggggttggagagtaygtaagtttggagtttyggygttygtttttyggttgtygtyggtttttgtagaatygagtggtyggatggtagttygyggggaggttyggttattygttyggttygttyggggyggggagaagaaggagagttggagagagaatyggtygyggyggtyggagaggygagyggagtgtaagagaggygagygtttttgttyggygttygggygygtttttygtttttttygttyggttygtttgttygttggttttttttttttttttttttttttttttttttggttttgtttttttttttgattttyggttggatgattgaggtattttagaygtgggttgaattagagygagygagygagtttaggggttgtagygatttttygataagttatttagaggygattttgtgygygygygttttttagtggttttygttygttttttgattatgttgatatatttataggataggtagtagtatygatgyggygttgygaygttatagttttygatattttttttttataatttagttttattttttagtattygatttgtgaaaattaygtttatgtagtaatataattggttygaaagygttaaagagttaattaagaggttttyggtttttygtagtttatagygtagttygattttttagagtygtygagtagaygttyggtgaattttagaggyggyggagggtggygaggagttttygttttttttygtttttttttttttygatttygttttttttttttttttttttttttttttttttttttttttttttgttttattttttttttttttaaattttttttgttttgygygtttggatatagatttaggaagygaattygtttaygttttaggataaggaagagagagaggtaygggagaagagtttagtaagatttggattgaaatygagatatttttyggaggttyggagtagaggaaggaggaggagggyggygaayggaagttagtttgtaatttaagttttgatagygttggtagaagggggtttaaattagatttttttttttttaaaggagagagatttttttygttttttygttttttgttaaagtygggtttagtatagttgtagaygttattagtgagaaagagggagaggaagatagatagggggygggggaagaagaaaaagaaaggtaaaaagttttttaggagaattttttatatttgtaataaaagatttaggggttggagagagatttttgggaygtagggttggagtgtttatttygagtttagyggtagggttygggygygagtygagattttgttygtttttttygtttttgaaatygaygtttaggagyggttttttaaaaaygtaaggtataaggayggttattygygygattatgtttgttgatttttygttttgttttttttaaaagyggttttttattttttaaaagatatttttttttttttttttgaagtgtattagttgtgatttttgtttttttttttttttttttttttttttgttttgttttttttttttttttgaattatgtgttgttgttaaataataataaaaaaataataaaatatagtagttgyggatttgttttyggttggagtttagygtttygtttggagtggatgagtttttttatgagagattyggttatttttgggataagtatggtttattattygtttttattttatygggygtyggatttygttatgagygyggtgttgggttattagtygtygttttttttygygttgaygttgttttttaayggygyggyggygttttygttgtygggygttttggttaagtygattatggattaattggtgggggyggtygagatyggtatttygt

SEQ ID NO: 11284 - DNA, 2548 bp, Artificial Sequence
  Description of Artificial Sequence: Synthetic polynucleotide
yggagttgtagtagaagygttttygatttygtttaggtttttagtttatttttttttgaaggtyggtagggggygttattatygttggttttttygygyggtttyggttttygtttygggaatygagtgtttgtagttygygattttggggaggtatagggttagggtatygtttyggyggagaaagtggttgtgtygygygggtggggtygggttagggttgggttgggttggagggygyggggtatttgagtgaagtygtagttttygggyggggtgtagaggagattttttgagygttggagyggggagagttagggygggggttaggygtygtagtttyggaygaggttygagtagtttttgygygtttygtagtaggtttagtagygtgtgygttagygagygtagttttgyggatyggataggagtyggagyggyggttagaggttggttaggtttttttttttttgtttttygttygggttygggtgaatagaattgatygtatygtygtyggygttgtaggtattgttggtgygttaggygygtataggygttttgggatttygggtataggygggtatagaaggygtagagtygggyggygtttgtttgtagtttttggggggggttttaggttagaagttttttgtagttgggttygyggttggaggaggttgttgygggygggataggggttagtttattttttgtttggggttttagtttttttatttttttttyggaaggagataggttttttygaggtagaagggagttgggaatgggtatgggtygggtggaaaygggtttgttttayggttgttygttggggtattggggayggggtattggaaagagggygtttatygtttatttgtttttggagttagtttttgaatattgttaygygggtgtagatttygggtttttttggtttttygtagtygtttttttaggaggtgatttygaataggatttttttagggygggggttaggtttagaataggttagggggtttttygagttattttgyggggttaagagagaggaygttgtatttatttgttttttatgaygtttgttttaygtttggtaggtgtgagtttgttatttgtgtttattttagggatgaggatagagaggtttagagaagtygagtgatagatagaygtggaaggaaaagaggtygtagtggttttgggaaggtttagtyggtttttttttattagattgggtttatatttggtaygagttaaygtttttygttaggtattyggygtagagtatggtgttggggygtagttygggttttagggtttttyggtaggtgtyggtgttgagtaggggaataygggttttttttattgttttagttttaggttygtttgtagggaaggggtggaaggtttaggtttggagggtaagagtttygttttgagggttttttttttattattttttttgatttttttttttttgaaagagtaggtagtatttttttaaggtaattyggtttttttatattttattatttyggatttttagttttttttattaygygtyggtttatttaygtttagtattttygaagagggygttttagttygygatggygtaggyggtttyggtagggggtttttggggtttttggggtaggtatayggggygygtygattttttygggtttatyggygtttatagttgtattagggttaggtygttgtggaaggttygygggttaaattgaggagggggaggyggygtagggttaaggaagtaygggtgggggtgyggtgtttagttttgggggtttggggattgtttttttattttggggtggggtaggatgyggtttattggtatttttttygtttgtttttttygggatttttttgttagygttatagtttatagaagtttattyggggygttgygggtygagyggtagttgagaygtaggaaggataggggtatatttygtaggtttttyggagattttgttttttygttygtatgtygggttttttttatttgggggtayggagggygggtyggggaggggtttygttttagagggggygaattygttyggtygtgttatttttttygggttggtattttggyggggygggygyggygttttgagatggggaagttyggggtyggtygtygttagggggtagtagagattatttttttygygygtygttygtyggataattyggtaggtgyggggtttagygtyggggattttagttgggtaaggtttgggggttttatttattttataaagtagtgygttgtygtgagtatttaggaggtygttattaggaygtygtygtatagaggttgttygtygagttgtagttttattagttagggttaggtttygggyggygtygygttgttttttaygatgyggtygtgggttygygttatattggtagtgttyggaygtttttygtygtayggttttagaaaggggtaaggggtgttaygagggatatgttttggttattttygttttygaggtttattygg

SEQ ID NO: 11285 - DNA, 919 bp, Artificial Sequence
  Description of Artificial Sequence: Synthetic polynucleotide
yggtggggtgtgaaygggyggaagtttygtttagtgtttgtttaattatttttagtttgtggaggtygagygaatgygggtgtggggttygggtyggggtatatttaygygttgygttggtatygggattggatgtagatgagtaggygtaggtggtttygggggygyggyggtttttttttyggyggtttttygagygttgygggggagggtgggaygtggttaagygggygggyggyggggtgggygatagagygggygatttttttaygtttygggttttatttaygtgtagygtggyggygagagygtagaagttagttaygggygttttgtattggtygttggttaagtttaggttygggtygyggyggaaggtattttyggygtygggttgygaggggtayggatggttatttyggttttygttyggtyggatttattygttttttygygygtyggtatttattaggtagtagaygttaagttygtgtagygygygtygttttattaaygygtttyggygtaggyggtagaggaaagyggtttttaygygyggygttygyggtttyggggttaggggygyggttagtagtgttagtaygttttttattaygtygtygtygtttttttyggyggtggtygagatyggggygaggttygtagygatyggttyggyggggttataygtatagggttygggtttygygygttttygttgtygtatygtatttggtatagagygagyggtggtygygygttagggattttttattygttygtygygtgggtttagttttgaaygataggtgttagygagattaggggtttgtygggygtaggggtggggygagggygaygttttttyggtttgaagggtttyggagtttttgygttttgattttgtagyggttttygt

SEQ ID NO: 11286 - DNA, 2488 bp, Artificial Sequence
  Description of Artificial Sequence: Synthetic polynucleotide
ygggtygagttygaggttgttyggaggtttagggtttttatttygygatgttagttttgtttttttttgygtttygggtaagggtttgttygtttgggggatygtatttggaattygygtggttttttttttyggyggtgtygtttttayggatagtgygtgttygggtttgggttggagygaygttttygagattattttattattttataattgtggttygygygtygttaggattyggttyggtgtgggttggyggagtataatgatyggyggyggggygggggygggtaygygggyggygggygttgggggtygygtagatgtttgggtygaataggtgagygtttttyggatattygggtgttygtggggggyggggaggagggyggagggggtgtaaattaagtggtgggaaagagataaaggaagagtgaagagygagayggtgyggatggggaagggggaggggygyggaggggtagtyggtgggtagygygtygaggagttygagtttgaatttgattaagtattgggggttttgtygtgggggtggggygggggtayggtygagagtyggttaygtgtttggtttttttagttyggggtttygtttyggtygttygggggagtygaatttygaggttyggtagtttygttttataagtattygygtttttggggattygaaagaygtatgggggtygaaggttgttygaaggggtttygggygtygagagtttttgagggtgtttgagttattttatttgggttaagttttttttttttggtttgatygtagatagttygtygggtgttttttttttttagtttttatyggatttagagatygtagttttygggagygatgggtaggtatagattttagygtttttttttygggtttagtttygtgtaaggatttttttygaagygttttttttttaagagygygttttttatygaagygtayggyggygygtttagygygtttttatttttttttatttggtttagttttttttttttttttttttttttttttygygttttttttttttttttttttttttttttttttttgggtgtttttttttttttttttttttttttttygtgtttattttttttttttattygttttttygttatttttttttgttgttttttttattttttttgtttgygttttttttgygtttttttttttttygttttygtttygtgttyggtttygttttttttttygttttttygtgttyggtgtttttttttttttttttygggtygyggygtygtygtygttgtygtygttgttygtttgggttttttttttggttattttygttttygggtygggtagtgaygygtygyggtggtgttagttttttttttygggtagtygyggyggtagtagtagtagtagtagttggagttgtggggttgttatygtygttygtttygtttattygyggatttygatygtttattttygtttygtttttagtttaggtayggagttyggttyggatttyggygatygggtygttttyggggttygggtygtygtttttttttttyggttgttgtygtyggtygttgagttgyggttaggggggygaggggttgggggyggttttggggaggggggygtagggggagttttttttgtyggggttgagggagggggygygggggagyggttgygttttgggtygagtgggttggggyggggggygggtgagtgtgttygagagtggagggggggygatgaaggttgtattgtgggggtygyggggygtttaagaggtgtgtttggttttgagygtttagggtygyggggygtattttattttyggggtgygygtygygggttttggggggyggtgattgtgygygtagygtygyggtattgtgttayggtygttyggtgtgtagygggttyggtatygygtttyggygagggaggygttttttggyggyggggygggggtygggttygggttgtygyggtygttaygagaagggaagtggattgtgtttggggatgtgaggaygggaagygttgagtgttagggaggggtttttyggygyggygyggggagttgagaygyggtttgtagagttgagtttattttagtaggttygggtttttttygggaggggayggggtgttttttttaggtgtatygtttgatyggaagtygygggygttggyggtttttggygaaggggttttttttaatgaggggatayggyggggygggggtagtyggtygtttygagggygygygtaggggttaagttggatttatattttygtttttttttttttttttttattttgtttttaaggttggatattttggatagggaggaggggggagtgtaattygtatttttattttagtygttygggagtagaagtgattttgtttttattyggagttgygtttgttygagttyggtygtttttatygggttgygt

SEQ ID NO: 11287 - DNA, 513 bp, Artificial Sequence
  Description of Artificial Sequence: Synthetic polynucleotide
yggtygggtttgttayggggttttgtgtagttttttttattttttyggttgttagygtttygtttygtttttttttagtttttaagggaggaggggagagttgtagagaggaggaggggtyggggaggtyggttttataaaggyggttggaataattttgttygttagatttygtygttyggattttttgagttgttygttattttaygtgatygygtygttttttagttttatygttgagtgagttggggygygtttttatttygtttttagtttttygtygagtygygtggtgtattgaagtyggygtggggaggagagtygatgaaggagaaygttaatatgggggttttaggtagaatttttaatgggagagatttaggatttgagggagtygggagattygggagtttayggtttggtyggttattttttttttttttygggygygaggtttatgagatygtaagttattttttaagaatgygygtgtagtygttgtygtggtaaygt

SEQ ID NO: 11288 - DNA, 1766 bp, Artificial Sequence
  Description of Artificial Sequence: Synthetic polynucleotide
ygttttttgtttattygygttaggtyggttttttttyggttttttttgtggygygagggatagyggaaattayggtagatagtatttttttgagtttaattttttttttttyggaggaagtyggttttttttttttatgttattttygggttatttttggataatagttgttatttttatttgagtygaagttaatttttyggggagttttygggygygtataggtagttyggtttgttttgygattgagttgygggtygyggtyggygtyggtttttttaatggtaaatgtgtgtggttggaggygagygygaggttttyggtaaaggtagtygagtgtttgtagatyggggygagttttgtgaaagtagataaaagaaaatatttattaaygtgttattaygaggggagygttyggtyggggttgtygtatttttygyggaatatttggttttttttagtttygagagaggagaagaagaaagyggaaaagaggtagatttaygtygtttttagttaagtggatttgatygatggtttttttgaatttattaygatatttgatttattagygatgttttttggtttgtgtgttaygtatatataygtgtatataaggttttggttygtttttttttttygtttttagtttttgggygaattttatatttgttttaatttttygtygagggygagtaggagygagagtgtgtygagtgagtgtgygtttgtgtgtttyggygagggtgygygttyggygtygggagygyggttagtygagttyggaggtatygggaggtygagagtygtygggattttagttttgygtttattgtttygttyggagttggatttyggggtyggggtyggggtygtgygtyggggataggtagggtygggtygygggtygygygttttttaggtyggaggtaaaagygttagygygyggagggttygaggagggtatygyggttgggtttttygygtttygggttttagtygttygyggttttyggttygaygtttttygtttyggagygygttygttttttttgygtggaggtyggygggtaggygagyggggggyggtagygtygtgttaaggggttggttggggtagygtggtyggtygggttggggygatttaagagyggttygggyggggtgyggagtyggattttggttggggyggygygyggggagggggtygggggyggtggyggyggygttggggggyggggaggaggtaggaggaggagtagtagygttygtygggggatgtagtagyggtagyggyggyggyggyggyggtagyggtagyggyggygyggagttttttgygtttagyggttyggtygggttgyggtagaggyggyggyggygtttygtttygggtgaggttgtyggggtygtgygygttggtgagtggggygtggggggtaggtgggtggttgggggaygyggggttygggygggggttygyggyggtyggagtttttttyggygtgagttyggtygygagygtygtttaggtgagtyggggttggttyggatygttyggttttagttttagygttgtttgyggaggtgggttygggygggygggagggaggtttyggygtyggtygttygtagagggatgatttgtttgatttygttggttggygggygggygaggatttttygtygygtttttgattygyggatayggtatatygagtataggyggtttygggtaggggagygygtttgggtyggttattygt

SEQ ID NO: 11289 - DNA, 6511 bp, Artificial Sequence
  Description of Artificial Sequence: Synthetic polynucleotide
ygtagggtgaataggttyggttaggagtygtagygtygtttatttgtatttygtttatttggtgaggtatgtygtggagttttaggttttyggttaggttygyggtatttagggygtgtgygtggggtagtagtaggtyggagyggyggtaggtatttttgygggygtttatygygttygtttttagttyggagaggtggggtagtaggtyggtygggygttygtggtgygagggtagtttygtttttttttggttttggyggtygggttaggtttgttgttggttgtttgtgggygtyggttggtgtagggggttgatggyggyggygtaygttttttttagatgygagtaggggtyggtygattgggagtaggttagttgttggtagggagggggaaagtagggtggyggttgatattyggygattttagtgtgggagaggggtggygyggggttgtagaggtgttgttyggyggaggagaggtgggggattygyggatttttattgttgttttygtygtggygattttggagggaaaaaaaaaaataggagatttygttagtgygaaatttygttattgygaattggtyggtatygtygggttaygtagagggtttygggggattaatygtatttygttyggyggggtttgtttagggtyggaaggtattygggggtaatgygtttygaggatttygttgtaagtaaagagtgyggggagggaggagagtttggtgaaagatttgggggaaygagtttttaaagttyggyggygaaggtttaggygttgtttttaagttygaggygtttggaggygttaagttygaattttgggttttgggttagaaaagttygtggtyggagttyggggygaaggagttagagttyggggygaaggagtyggaygttyggtgtagagttatttygtggagttygtttatgaygtagggattgttggaggtggtagygyggtaggygyggatagagtgygyggygygggaaatgygtatttttttygttttygggatttttttttttaygttttygggataaagattttygagygggyggygttyggaaagtagggttygttattttgygtygttttgggaagtgaagagggagygygygtatagggyggttttttttgttggtygggtttagtygaggggagtaataagtgggggygttttgtattgttaagggtagtgttttygtaygtyggggygtagagggggtatgaagaattttggaaattgggtagttttgttygygtaygttttttygtttttgggyggttygatttagtttttaaaggatgygtttttatttgtttaggggtttyggggygtygggaatttggaggaatatggygttgtygttttttggyggaagygttygggtttgygggtaggggtagttttttagggttyggaggygtagtgaattttygygagttygtagttygagtttygygttttyggygtttttgagttygtttagygttgtttgygtttttttttttttttygttygtygtttttttttttttttttatttttygaaattttagtttaatttgttygataggttggagtattygygagtttttayggttttatttggtttygggtatttttattattattttttagtttttattttttttgaaagttaaatttyggttgttttygtgttttttygaggaggtagyggggtaggtgataagtyggttttggaggagtgttygttaaggtgtygttagtaggtagttttatttgatttttttggatagagatttygtgygtaaaagttaygtttgagggttgtagayggggtattttttygagaaaaygggaagtagggttgtttgtygtttaggaaagygttyggtaagttgtgtgggtgggatttgttattttttttttaggtttygttttygaggggaggttatttaggaaaaggttttatataggaaaggggtttygtagaaatggattaaggggtgttyggagaagtggatttygttttatygagaggttagggtttttatgttttygttttygatttyggtttagtggtttttgtttttyggattgttttyggyggggyggggttgtatttyggagttttagtttatttygtagtttttttygtatttgatattatyggttattttttataatatggygttyggygttttttaaaatagtygttagttaaatttaggatttttttagtttttaagyggtaaatttaaaatyggggttayggtgattaggygtttgtygtygttttygtygygygygggttttgttgttygggttattggataygtatyggyggttttgygagygtagatgttgtygtygygagtgttaagatygtttygyggayggggaaagtygygttygaatagtgtgttttggygatagtygggggattygagygttttaatgagaaggaaattattataattttttttygggggtyggygyggaggtttaggygtygggyggggyggtttttagttagttttagtttagtttygtttygtattygggtttggygtagygtygagttttaygttgtgagggaygaagygyggagttagtgggyggtgtttygttgatagtygaagatttgygaggtttgggtttttygaygygttttttttttgttatttttatygtaaatatatttgagattggtagagttgggggaagggatttaaatattgaaatttatttttttttygtttaaayggtttttattygtttttttaaaagayggatgttatttggagttaagaaattgygtatttggggagygatttaataatyggggtttttttattttttaaaaatatattttattttatttatattttattgaggtttaaggtttgagttgggattatgtagttggagttttagtgygttagagaygtttagtttttttygtgggtatagygyggtttyggttttygggygggaggagagaggaagggatttttggggagtttgttttaagggtygtagaggtagtagayggttttattygtttaggagttgyggatagyggygtttygtygttgtygttygaagtggtatttttygyggttggttgaggttagggggaattygygygtattggattagtttagyggttyggttttgttttgttttgyggaaygtyggttttgtagttgtttttggygggtyggttatttagaagtttttattygttttgggaaagaagygtygggtaggaataaaattygagygttaygggtaaggtgagggtgaggaggtgtaggaagttgggagagagtttgtagagagttttygattggagaggtagatatttaggttttatatgtttagatagaaaaygaaatttttttttatataaaygttgtttttttttttttttyggtatttgttatttaaatttgaaagtaaagtgtaatattaatttttaaaatttaaattaaygaaattttttggtttagttattatgtagtaattgatttttattgtaaggggaatatygttaattttygagggygtatttgttgggaygttttaattggttttttgggttggatttaaatattttgtggggattagaggataagattatttttatttgatattgaataygattttgtaataattaatgtttattagtayggtgttygtatttgtagtagatatgatttttttatttayggaatggyggtatttattgtttygttgttttttttygggttygtttgaattttagtatttatttagatttaggtgggtttaaaagaaaataataataataggygttttttaagggaaattttttttyggttttagatagtagttaaattttaggtgatttttygatyggaygygggaataaaatttggaagttgaaattattgagatttttyggttaagtatatttgtagggttttgtattaaggagaatagtgtataaaaagatatataggattttgatatttyggttttaaaataggtttttgggggtaaaataagttatygtagaagtagygtttttggtattagyggygggggagggggatatttgttagaagtagaaattagatttaggttygtaggtattttagagtataggtttaggaagatgggttttagattygttagaggtgyggygtttttttygggygtttgggattttttgaygggtgtygttgggttgttygatattttgggttttttagttttyggttttattttttgattyggtttgaggtgtagtttgaataagttgttttgtttgtgttggtaagtttattttttgtaygttggggttyggaatgggtaagaaggtgtttattttttattttaggttttggttttttttttttatagtaatattagttaaagttgttyggaggaatygatatgttttttygtttgggagygtttaygtaggaggygaagggagtygatgggtattgagggttygygtagtatygtgtygtgggtttaaaggatttagaggattyggaatygtttggtaaaggttatttatttttaaggagtttttttggatttyggygttgttttttttttaatgggtaagygttygaattggagygtaattttygygttttttgtayggaaggtagttagaataaattttttgttttttyggtaygggagatttttttttaataygtatattttyggtttttgggtyggtatttaggtaygygygygtttttgtgaggaagttttaatttttttttgattttaatttttttgtttagtagagtygggaatygaaggttttagtatttaagatagtttttttttaaygttttygttttttgtttaygtgaagaygyggattgygtggtygygtttaagatagtyggtatyggtagaaggggatttttttggaatttyggaggtttygtagtygtttggagaagaggatggaaggttgtygggggtttttttttatygttttttagggagtttaaatttatttattttttggaagttttggatttaygtttttatgaaatygtaaattaggtttttgtaatagygggagygttttaatagygygttatttttaaagaggygygaggtggtgtttttggaaatagggttttyggttttaggtttgagttattygttatttttgtttttattttagayggaagaaggyggttaggygggtagagtaagattygggtagatttgygattttttttttygttttagggaggggattttygagtagaagatggaggttttygagygttttygtagatttygygttaygygtyggaygtttgtttygtttttygggataaygtgagygtyggtagggattttagtaagtggtagattygttaggattaagtaaggtggaaaggtyggggtttgyggtaaatttaggaggagggggtatttaygttygttatttttttttygyggtattggtatttattggatygatattggygttaaagggtattttgaagtatttatgtttagtaagggtatgttttggggtattatagatattaagttatagttattttaaaataattataaaaatgattatygtaaataatagattgttttaatagggygygaagyggtygtygtatatagaygtttttggttttagttttattagatttagtttattgttygtttttttgygtttygygttaggtygtatgtttttygtttagaattttttgagttttaatttttttttttaaataatttttttttttaaataggtaaagtgaggygaggagttgaggggtttataggtttttaagttttygaggagggttygggtttaygttagtttyggttygttaaaygagatttygtgggtatagtttttaatttgataattatttgttttattttatagtaggtaaaagtgaatttttagtygtttaattatttgaaagttataaaggtgtttagggttgaaggttatttttttagyggttttattagggagttygttagagatatgtttgattttttttttgttttgtttygggggggattttygttygtyggaggttttataygtttggtygtgggatggtagatttttgttatttttttattaatatttyggagtttattygtaygtattttaatygttyggagygtaggttygaggattaaggyggtagtttygtgttttttgaggtttttttygtttygtgttttgggtygttatatatttttyggttaagttyggygtttttaatttagaatttggtygtttttaggygtggagtaggttattgttgttagaygttgygyggattygtttttttgygttagtattgggygataggtagttygggtagtatttaggagttattttgtayggttttaggygttygttttatttagygttatttttygtttttygtagygagttttttygtagttttttttttttgttagttttyggggtygt

SEQ ID NO: 11290 - DNA, 6511 bp, Artificial Sequence; identical to SEQ ID NO: 11289
  Description of Artificial Sequence: Synthetic polynucleotide

SEQ ID NO: 11291 - DNA, 338 bp, Artificial Sequence
  Description of Artificial Sequence: Synthetic polynucleotide
yggaaatttttaattygygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatygyggtgatttygttgyggatyggttygyggtgattttagygygaaygagttggttgtyggttggggygagaaaggtttgyggatyggtttgggygtatgygyggaaggygg

SEQ ID NO: 11292 - DNA, 936 bp, Artificial Sequence
  Description of Artificial Sequence: Synthetic polynucleotide
ygtaggygyggggtgttttgagttttttaatttttagagggaaggagtttatygtgggggatyggttaaagttttattttttgttyggtttagggtaaatyggtttttyggtagtttagttygtttagtttttttygagaggatataggggattyggagttygtaggggttagtattatttttygtttygggtttygttttttatttttygtygtttygagaygtttygatttttagttyggaggtgagggtttttttttatgtaygggygtttgatgggggtaggggtggggaygtaygagagttttaggtttyggttyggatygttyggggttttaaygtttttttttygggtttaggaatagygttttygtaggaagtatttgtttyggagggggttttygggatgtatttygtygtgttygygttygatgttygtttttttagggtttygygatttttggggatttttygtttttyggtttagggggtatttatttygtaygtggagttygggtagygtttttagaygtatttagygggatatyggagaggaygtygaygtagtgtaaygtttyggtygaagygtygaataatatgygygygtygyggaggaggtgyggggygtgttygtttaggtagygggtygtttygaygtggtagaagtttaggaagtygtagttygygaaggataagttttagtygygttttgygtygtatatggyggyggyggyggggygggggygygggttaggatttgggtygggatygggaatyggttygggttttgattygtagtagtttygttyggygttygtaagygttttttattttgttttagtgtttyggttagggtatttttagygygaygttagtttygtttttttyggattatgtaaatgagtyggygggaggtttaatgagygggtaggaygt

SEQ ID NO: 11293 - DNA, 2184 bp, Artificial Sequence
  Description of Artificial Sequence: Synthetic polynucleotide
ygttaygayggggattttattaygttgttttttatttaygttattygtttaatttaygyggagggttttgagggttttattaygtagttttgaaggggtagagttggggttatataggtatyggaagtttaygttgtggttttaggagaaggttttggatgtggtttttatgagtgaagggtggatttatagygttgtyggaataaagggaaattataggtaggagggaagygygtttaggattygyggttatyggttttttagattgttttttggggttaggtygygaggagatggaaagygggggtattataggttygtttgaattygygygtttattyggttatatygattttaaatttttgtatgygggtaggatttttggtttttttgygtttattttagttttgttggtygtyggggtatttgagggatggttgyggggggtyggagggtggaaggggygtygggtagtttyggtggggaggggaagaggtttttygtgtattatggattttygtattygggaagggaggygttyggggttggggagggaggaaaaggyggttgtgttyggggagggggtagygagatttygttygggttaygggttgtaggatggagyggaygggaggaaggagttttgaygtygyggattttaygtttgtyggtygttttttttttttttgttttttttttttttttttttttygtagaggtagygyggggattyggtyggggtggggttagggyggtgygtttyggagtttttaatttggattttatttyggaggygtygygatygygttttygtygtttttaggaaggtgttyggatygygtyggygatyggaggattttgygtttygtygttttttattttgtttygtttygygtttgtyggygatttygyggggtyggttttygtttttatttgtagttyggggygyggygtttttgagggaagyggggttttgggatttttyggtttgggygtgggatattttayggttygtaygaattttggtggttygggtttttgtttttttagaatagygtttaggtttyggagaaatttttygaagtygtgggtttagaygttttygggggatttyggtgggaygggtagggygggygtygygggygaggggaygygtattgttttygggygaattagaaatattttatatygggtatttttttaggaatygtttatttatttttattgttttttattaggttttattttattattttttttttaggtatttttttygttgtatygtttttaygygggtatygtttttattygggtatttyggttttgttttgttttggggtggtygtagttygyggggaggaagygyggygaggygtttatatygggaaagtgttttygtgattttgygaggttatatttygggtgygtygttgygggttygtgggttygtgggttgtagtttttygtttttgtygggtggaygagtttygggttygygtggagttgttyggttaaggtyggttygggaggggygyggygtagggygggtaggggyggggttttaggttaaygtttagttttagatttagtttygtygtyggatttatygtgtttttgtttttttatttttgagaaatyggaaygtyggyggtattttttttttygggtyggagtttgygtttttyggattgygygtttttgtttaggyggyggtygggggtgggagygygtagygggttaatttttttaaagggaattgtygggagggygtttagaagggaaagattaggaagygttgggtgttgagttggagtttggtttttttttgggggatyggggagggggttgaaggtggggagaagatygtyggggttgttaggggggtattgagggagygtttagggggagaattttgggtgggygaygtygtaggggagttgtttggtaggggygagggtttyggggaagtggagtttttggtygagagttgtatttgtggtyggggagggaaagggttataagggtagtgygygtygggagggaagtttaggtyggggggaagggattgygyggyggggataggtgygtygggtgttggatagtgagtaggagttygtyggtgtttaggttaygaaggtgttggagtygggggagttggaaygtaagggggttaagggaaygygt

SEQ ID NO: 11294 - DNA, 413 bp, Artificial Sequence
  Description of Artificial Sequence: Synthetic polynucleotide
yggtttgayggyggggtygagtaggggaagtggaaggatggagggagaaagggagagagttttagtygtttyggttgtggtaggaggagttttaagagygtttttygagttygtttygtatttttaggtttagttyggygtaggttttttttttygttttttttattttygttagttgttgaaatttttttatygttttttygygggtaatagtgttygttaggygtygtygygyggtgtttygttttttaygtygttygttyggaaagagttygtagtggttyggggygtygygttttgatygaygtttttggggtttgggagggyggygttgagagttgggagaggygttgagtttttyggtttttaygggaygtygggaaaggagagygagygtaatttttaygtttygg

SEQ ID NO: 11295 - DNA, 403 bp, Artificial Sequence
  Description of Artificial Sequence: Synthetic polynucleotide
yggttygygtygtygtgttttttattyggttatatagygattttaaaagtttagtttttatttygyggagatttygatagttttgggaggttttttttaaaagggaatttggagaaatttgttgttgagtaygattgagttttattttataaaatatttattatttygtygttattttttaagtttaygtttttaaatatgygaattttaaggtttagttygggagtaagttaattttaggattyggtttatyggygygtgttttgaaaagaatgtyggaggttagatttttttttatygtttagaggtttyggtttagygtatatatttggggttygtagggttttygygygtyggaattygatttgygttggattttttttygggygtaggagttaagyga

SEQ ID NO: 11296 - DNA, 675 bp, Artificial Sequence
  Description of Artificial Sequence: Synthetic polynucleotide
ygttttatygtattttagtggagtgtygygaagttgtaattyggttttaaggyggttygtatttttattygtatataaaggtaggtygtagtttygtaygyggggatagggttagtaaggggyggggattttyggggtygtygttttygtagtttygygtgtgggattttggggygggtygttattttgtggtgyggtygtygtttgttaggagatatttagtaatttygtagyggttattttttataagaaattttygttgtaatygttgygttatattatygygttttttagggataggaaagttttttygtgtttggtgaagttttaggggaagtagttattttgtygtygtatayggtaaaattttttattgtygtagtygttyggttgaygtgataagggaggtgtaggttaatayggygatttygygttttttggyggtagtgtyggagtagyggygttgtttttgatttattyggtattyggttttygggatygtttggyggttgtgaatgtagagttggggygaygtggggttygttttttgggattgggtgtgagtttgygtagtgagttatatgggggttatggtttggygtgggggygtggtygggtggggtygttggatttggtgttggaaagttagggaagtagtygtgygtttaagaaygg

SEQ ID NO: 11297 - DNA, 580 bp, Artificial Sequence
  Description of Artificial Sequence: Synthetic polynucleotide
ygaagagttyggttaataaagtaaaygtttygttttyggttttttttttttttgtaggggaaaygaattgaaygtttgaaaygaaggtggygyggtttggataaatttgatttttygatatttttygtttttgygttygttttygttaagyggggaggagygatygttataatggattttttygtaggttttgtgygygttgggaatttagttgtygtygtttygtagagttttttgttttyggagggygtttattttygggtygtttattattygygtagtatyggtagtygttgtttyggtagtttttagtygtttygttygtttgtggttaattggttttagttatttttygaaatgttagtygattttattgggtattggaagatgttggttaaygagaatttygaggagtatttgygygttttyggtaagygttgttygttgygttttgggygtttygtygagtagtttygggtygttttttagagttttttygagaygttgtttgtttgtttttatttyggygagtygyggttyggtgttttyggaygttagaaagggygttttyggttatygt

SEQ ID NO: 11298 - DNA, 858 bp, Artificial Sequence
  Description of Artificial Sequence: Synthetic polynucleotide
ygggaatatygttttttygttagattttyggyggtttttttttttttttttaaatttatttttaaagttaagtgtaggttttttygttttagttagaagygttgygtgagtttttataygtagtygtaggtagttttttaaatagygttygygttgagtaaatagtttagaygtggggtttaggagggygagttgaggygatygtatygggygygtagyggyggygggttagtyggyggttaatagttagggygyggttygtttygtygttttttttyggggagtttataaggttttygtagygtttygggygtttgttgtttygtgtttttatygaygattttatttagttgygttaygygtygtttyggttgtyggtygygygttttgttygtyggttttygttygtaatyggyggtttagggyggattygggtttttgygttttygygagaagygyggygttgyggggtygtgggygtttgagttygygyggttttygagggtygaatatggggggatgtayggtgaagttttagttgttgtttttggygttygttttttatttttggaatttttgtttgggtgyggattyggagaagttttygagtatttttataggtgagtatttygyggttygtygttgtttygygaggttyggtyggygggggggtagtttatttatttattagttttttygyggggttggttaggtgagtagtgggggtttgttttttttttttaggatygtyggggttttttttagaattgyggtygggyggygttggtttttggggaagtgtaggggtattygttttygttgattttttggagttttyggtgaatttagygtgttyga

SEQ ID NO: 11299 - DNA, 5715 bp, Artificial Sequence
  Description of Artificial Sequence: Synthetic polynucleotide
ygttygtatygygtatataggtagtggaygttygtttatttgttygtttgttgggygtagggygtttttggggtggggagggygtttttgtggggggaaaaggggygtttttgtttyggagggggaaaggaygtttttgtggaaggaagggggggtttttgaagyggtgtggtgagaggaygttttygaggaaggaagggggtgtttttgtagyggtggggggagaggaygtttttgyggaaggaaggyggygtttttgygggggttggagagaygttygygyggtttttyggtttagggatygttggttygygggttygtttttttttyggygttatggaaatygtatttttttygtttgtygttttygattttttttttttattattttttaaaygygattttaatttttygataagttgataagtgaatggygtagaggaygtttygtaaagygttygygagygggtgggatataggygtttttttygygtttttttgttttttayggaagggygygygtygttttygatttggagygyggtgttygygaattygyggtygygggttttggaattttttygygtttygyggttgyggggggayggagatgyggtygggagayggggaygggaaaygggggayggggatggggygygtttatttygagygygggagyggtygttttygtttaaaatggggatttygygtttygagagtayggttyggttygtygtttatgtttttattgtaaggtygtagttttygtygtygatttygatttttygtttygtttagtygyggtttygttyggygtttttttttyggtggaagtttaagtttaattaattgagttygaggygggagggaagggttttgygygtygtggttygtttygtttttttttygygttttttttttygttttgggtggtatttttttygtyggtatttataataagtygttgattaatgaggtyggggtygttttatttygttyggtygggtyggggttttygygggagggggaggggayggygggaaaygyggttyggggagaaaggggggyggggygggggygygyggttygttttygygagygtygygtygattggtygagygygtygttygtyggggggygyggygttaatgygaggtagyggggyggggyggtygygttgtgtgtgtttgygtaaygtygagttatatgttgttttgttttttttagtttagttattyggtgygygatgtgttatttattgtgyggyggggatygygaygagttygggtygtygttggtagtagtagtagtaatattagtagtagtagtagtttyggyggyggygyggatttygagygttygggygtatttyggtttttyggagygygaygyggyggtagtagtttyggtgyggtygygygygttttaggttyggtttygyggttyggggatttygattttyggtttagygagygygtttttyggygtygttygagagttygaggaggtagyggtygtaggtagtyggggaggggggyggttatygttygygtygggtatttttaggagttttagagygyggagggygyggygtygtygagyggtgttggttttygygggttttttyggattttttttatygtttgggttygagggaygygtgatygggygggyggtygggygtaagggtgggagggagtygttttygttygygtttttttygtttttygttttaatttttgggygtygggttygggtygygyggtttgaagygttygygatggygagttygtygyggtaygggtygttygggtyggygagyggagayggttttaattttaataataataataataataataattatagygtgygtaagtgyggttatttgygtaagtagaagtatggttataagygttttttygtgttgygyggattyggygygggyggygaygaggygayggygggyggggggtyggygtygtaatygtygyggttygagtattaygagagygagaaaaagtggyggagtaaggtaggygygtygaaaygggtgatygttttygattgttgtttgaatattaataagygygtygaygttaagtataagtatttgatygttttttatattaaggaygagtatttygtygtggtygtygagaaygagtaggagtaggagggttggtatygygygtttatygatttggttagygagggtygygyggtygtyggagaygygtttttygtygtygygttygtygygttttgtagygtttttttgttyggygttttgggyggttttgtyggygtygtyggggtygaggatagttaygggttggtggttttygttayggtygtttatygtgaggtgtggtaggtgaatttgaagtttaagggtttgggttagagtaagaatttgaygggggtgtatygtttgtgtttgtttgygygtattatyggtttygtgaagtttaattgygagtagtygtyggtgaygttgtagtttatgaatattygtygttgyggttattyggatagttttttttttatygaggtgggtygttyggtygttataggtttyggygagttgtggatgtaggyggaygattyggtggtggygtagaatatttaygagattattttggaggttatgaaggygtttaaggagtttttygagtttyggtygygtagtaagagttaatygtyggggtygtyggttaygtattttattagygttttyggygygygtygttattattatttggttaatttgttttttagttagaygggtttggtgygtygttygygtatygatagtttggtygttatttygtyggyggttaagtgtagttygtgtygggtgygtatygttagygagggygayggyggygyggyggygggagyggyggtygygggygttaggtyggtgtyggtggttgggagttttttgagtttygggtyggtgygygygtttttgagtygttygtatattttgagyggyggttgyggyggtygygggagtaaggtggygttgttgtyggtagggggygygttgtaatatagtygttttatgtttatgttygtggygtattygtygttygtygttattagtttyggttttttgtygtttagtagyggttayggttygggtttttattygtygtygttyggttygtattygtttttgtygtattygttgtattayggtttyggttagyggttttttagyggtagygttttygtttygggtttttttagygatttyggttttatgtttttggaygagtayggttttagtttaggygatttgygygttttttgtagttatygaagtaataygttygagtttatygyggagaygttttyggttygagayggyggyggyggyggtgagttttaygggtatatgattatggataggtttttgagttattgtggtygtttttatygtygggtttygggggaygyggtttaggatttggatygagggttgygtaagaggatttattttttgattaygttagttyggtagyggtyggtgttttagtttttttttgtttygttggatgaatatattttgatgygggttattttttygggtagygygggtygtttttgttygttttgtttygygtttttttttaaggtggtttattatttttatttagaggattayggagatatygagatyggtttttataggagttttagtagtaatttgggggtagaygayggttatatgtttatgaygttyggygyggttttygygggtagtgggagyggtagttgtaggagygaygattatatgtttatgagtttygttagygtgttygtttttaagtagattttgtagtttagggtygtygtygtygtygtygtygtygtgttttttgyggggtttgyggggttagtatttatttttgyggygggtaggatattttyggygagygggggyggttataaggttagttygttygtygagagttttttygaggatagtgggtatatgygtatgtggtgyggttttaagttgtttatggagtatgtagatggtaagttgttgtttaayggggattattttaaygtgttttttagygaygyggttattaygggtatttygttygatttttttttygtagttttgtatttyggyggggagtygtttaggggygttttyggttgttgttatagttttttgtttygtttttataaggttttttatatttgtggyggggatagygattagtaygtgtttatgagttttttygtggggygtattttggaggaggagygtttggagttttaggttaygttagggtttagttaggyggttagygttttyggggtyggttttaygtagtttttttattttgtagtgttttygttygtgyggtttagyggyggtygttyggagggttttttgggttagygyggtygggyggtgaggtttaygygtttgtttttggaggggttgtttagtttgtttagtatgtaygagtatttattgttatyggagtttaagagtttyggygagtatattaatatygattttggygagttyggggttygtttgtygtygttygygttttttttgttggygtyggyggtttygtttttttygtttttgttygttagtagttyggtttygtygttgggtttaggtatttygggtattagtagygatagtyggtagyggttttygtttttygattatatgaatttygattttagtttttttaagttttttaagtygggygtttygagyggttatttygtgggttttttggayggttttttgtttttygaggtttttttttygtattygtygttgttttygygttygttygygttttygtygtygtttttgtagtygtygttatygtygtyggtttygggggagttgtatygtttgtttttygtttyggtygttgttatygtttagggttygggygtygttttatygttgttttyggatatyggggataatggtgattatatygagatggtttttggtgtggtygttatttygtygtaatttatygyggttttttygaagttagaagttgttygygtggttagttygaygtygggygtgaagaggttgagttttatggagtaggtgtygggagtygaggtttttttgtaggttagttagttttyggatttttatygyggygttaaggttattygygtagattygtaggggggtygtygtygttatagtttygagatttttttttttattaygayggttattttygtgttttygtttttygtttataattttaagygttataattyggttttygtggaaaatgttttttttaggaaaagtagygagggyggygtgggtgtyggttttggagggggygaygagtygtttatttttttaygatagttgtagtyggygttttttttggtatygtagggtyggtygtggatttygggttagttygggggtttggtyggttgttttgggagyggtggatygtttatgygtagagagatttttgtyggtttttagaatggttttaattatatygttatygaygtgagggaggagttygggttgttattttagtygtagtygtygtygtygtygtttttttagtygggagataagagtttttggggtyggattygaagtttygggggttttattagygttgtgggygtyggtagtatyggyggygggtgyggggggtygggtttygg

SEQ ID NO: 11300 - DNA, 858 bp, Artificial Sequence; identical to SEQ ID NO: 11298
  Description of Artificial Sequence: Synthetic polynucleotide

SEQ ID NO: 11301 - DNA, 247 bp, Artificial Sequence
  Description of Artificial Sequence: Synthetic polynucleotide
ygggtattgtttgtygttagtataaygaagaaatttatatttaygaagattttagattttaygtgattatattatttaattattagygttggtttggaggaattygttgttaygtgatygttygtgtttaatgatygaggtttaygttttttagatygttatagtygttgttatagggtttgagtttgggyggygtttygtttyggtygtayggtgygtyggygttaatttttttygaaggtttygg

SEQ ID NO: 11302 - DNA, 224 bp, Artificial Sequence
  Description of Artificial Sequence: Synthetic polynucleotide
ygtygttaagaaggaggaggagyggtaggaggygttgygttaggyggaggaggagygtaaggttaagtaygttaagatggaggyggagygygaggtygtgygttagggtattygagataaggtgygygtygggtyggtttygtttgygggaaggyggttttgagtttagyggggatttagatttygtttgggtggaaggggttgttyggaagaggggygggygt

SEQ ID NO: 11303 - DNA, 1174 bp, Artificial Sequence
  Description of Artificial Sequence: Synthetic polynucleotide
ygatgtggyggggtttgggaaatgygttygttggagtatatygtagtttygygggttttygagyggygygygygggtygaggatttttagggtttttygygggtttttygagygtygtygtatygtttttgttygygttygggatygtttygtgggtttttttgttagggtygtttgygtygagaggtagtttaggttttgtyggggaygtaygggttttatttttgattttttagtyggagttttttgaggatttgtaagtatataggttggagtygagaggttaaattaggttttaggggatttttttaataaaattttaaattttatttaggttgttygtaggttaagygattgtaaggattttgagtygaagtagyggtgtygggtygattygaggttygttttttatygtttttttttygggtyggttttgtgtagttggggttttggaattyggtttttttygggttgtyggttttggggtttggtgttygttatttttttttttyggaggtygttattgtttttttattttatttttagttttttygtttttttttaygtttttttttygygtttttttttatttgaattttttttttttttyggttggaagaaaagtyggtaatgagaaattagtttagtgttagtyggaggaggggggtagataattttagagatatayggtaatggagagagaatttattttgtgtaaagagggtttygagttattagggaatttttggattgttttaggttgtygtgtgtgatgtttattaygtygtgygaatattatttgttyggtattgtgtttttagttgttaggttatttgttgtaygtagtaatatttgattgtttggttttaygttygtagygttygtttagaygygyggggygggggtygyggaggggygggygggagttttgattaagttatttgygaggggagggggygygggygtagyggyggtygggtaygaggtygggttgatattattatttgttggggygygggaagaayggtagttgttttgygttgtttyggygagggaygtttggaaaaggttgaagttttgggygtttttaagttygttatttayggggttttygttattttagtttgttygtygtyggtygttttttgtgattttttgttttttggttygtygt

SEQ ID NO: 11304 - DNA, 8657 bp, Artificial Sequence
  Description of Artificial Sequence: Synthetic polynucleotide
ygagaygygtygattttttygggaagygygagygygygygtgtttgygtttttgtgyggatttgggtttgtygtgygygtgtgtgtaaaggtgaaayggyggyggagttttaaatattttattttygaattattttttgttgaggaattaaggttgttaggtygttgttgattttgaagagggttttttttaattgygatttttttaaggaattyggttttgtttatttttaaggaatgttttttttttttattttttagaygttgtaggtttttygygttgygtttttttttaggttggagtygtagttggygggaygygtygtttttayggtatgtygggtgagagtygtttaygagyggtttagygtggyggatttyggttttgagtygygyggaygtttggttaygaggggttttygattygggyggggagaggtgygatttggggggagggggyggggygygtaggaaggaggaggagagagaaaagggygaagttagygygagattaggaaggagaggagggtagagayggagtyggygagatgttggagaatttaggattgtgggtattttgagygggagagaaattttaggaagtaygtyggaggyggggtatttgtgggaggaaggtaaattttgtagagygttaaaggatgtygggagggataagttagttatggggagattttttagaaattyggagttgaaaatagggtagttaagtaagtaagagttggttagttgaataygaggtttttagaatgtaaattataaataagaaagaaagaaaygaaagaaaaagaaaagagygygygtagggtttygggtttaggygtttagagtagttygtgygggggttttttyggtttatagtagtygtygtttygygtttttgaagtggygttygygtggttattyggggattttttaggtttygggggtttatttgaaaatttygagaggttttgtatattttgttaggattggagttgyggggattttttagttttttayggatgtttttttgtaygtgttttttaggaaaatatttaggtttyggaagygtttttgagagtttagaaatgtyggttgagygtgaaatttagtttaatttatttatagagtattagatttagaaaygaygtttgaaagagatgtgggttttatgttgatttaaattttgttttatttataataaygtttttgtttttaaagaaaagaaaaattttttagttaaattttttatgttttyggttttttgtttttgtttygttttttttttygataaaygyggggagttttggaaygggagggtyggtgatygygaatayggtagygatgtgatttgatgtattgaaattatttatatttttaatgttattttattaaaggaaatttatataaaagygtttgttttattttaattgttaaaaaagtttgttatattttygaayggtaattgttttttygttagatatygaaagtttataaggaattataatgagaaaggattaggagtygtttaggttttattgaaatgtttygatgtygtttttttttttttttygaattaagtygtygggggaggaggtgggtygygtttatygttgtygggattygggtyggtagataygggttatagygttttttygtygttygygygtaygatttttggtttgygtygttttttttygttttygygatayggaggayggygtygygttyggygagygtttyggtttttttagtyggtygygttttyggggagatttygagttygagttttyggggtyggttgtttttygygttyggtttygtaggaaattttygttygttgaaatttgygtgtttaygtagattygttttaaattttttggttgttgtagggataataaagaaaaatagaaatagtgttaattttttttttattttttagggtatatttaggaaagggggtagggtttattaggaatttgaaattgtttttatygtttgggttattgtgattaggggtygygtttgtaaagtagttattgggttttttttgygtgtttgtttatttttttttttttgttyggayggtaattgaaaagttttagaagttaagtgtygggttttttttagygattttataggtttgagtatttygtttygtttttgagtaaaatattttaggttttttttttygggagtygyggttttgtagttttygtggtttygagayggagtttgggttgagttygttatttttttaggtagtttygtygggatygtygygttaagattttaygttggtagtatgtttttttatgattgattttttttttttttaagaagaagattaagttaattttaatttaagaagaaggaatgtgatttttttttttaatattagagagttttaaagtaaaaygtagtttatatattttaataataatgaygagtgttaagtttttaatgtttttgygtaggtattttaatttgttatagttattattaataaaaayggtatgtagtaagagtygattgtttaatagtgtaaggtagayggtttttattagtaataggtagtagyggtatggaatatatagattttagtggaggagtataattgttaaggggaaaatatatataggaygggaagaggttatttttaaatttttaatattgagttaaagagggggaagggtaggyggygtttttggagatgtattttgggtgaggggatttttttygttattgtaygtgtttggttatatatttaattgatgttagaatygattgtatttagagtagatattttagttttaaattgaggatgtttgtataataattggttgtttttttttttgtttttggtagaggttyggyggggggaggggggtgggttaagggagggggagggaggatgagttttaaatgttaatgaaattatagygggaatygttttttagaaatggaaatattttaggttagtgttttttggtgataaaaattatattygattttttttttatttaaattgatttgatygtaaaggaattttaaaggttgttatttgatttgatagtgtttgtgtttgttatttagygtgtgggttttttatttatttttttttttggaggaatttttttttaggaagygtaaaaatgtygtagattgtygayggtttgtttaattyggttgttttttttttttttttgttttttagttttatagtaattgattaaaaatatttgttttggattgaattaggatgttttatgtggagtygtaataaggttgaaatttttygttgggtygttgtagggggtttagtttgtgggaayggggtgtttgtgggtggagggagaggtggtygtgggtgtgtgtgygtgtgygtgtgttgagatggtttgaagaggatgtgtgtaggatgggggtgtggtttgtaggaagagtggtgggggagtagtgtgggygaaggggtgggtgggataattggtagggggygagtggttyggttygggagtttttggygggaggggtaaygtgtttggatygygtttatygggagtttgtyggtttaggaggagttatttttaagtatagtattgtagtttgtaattggtttttttgtatttggggaaagatagtttgatgtygtgagtgttttttttgygttttggattagattggtaattygggtttygtttttttygygtygttgtagtygtattatagggaggtygtaatatgttttgygttttgagattattaaggttgtttygtaggttgtagggttagtaggggtgtaggagtyggttgtaggtttgagttgaggttygttttaggttattgygtttttttttttttatygtatttattygagayggttttygaggatagaggtatttgttgggtgggtgtttttaataggttagtatagatttgatatttttttatttttttgagygttttttataggtgatttttyggagtgggtagttagaygtttttttyggttattttygagtggaaaagggttggagaagygtgatggggagagggttttaggaagttggggttttaggaattttygttaatygtttygtttttgagtttygtaaggtaatygtttttttattttagtygygygttatttgagttatttgtaatgtttattgtatyggyggygttaatttgagtttttgttygttttygaygtgattgggaggttttaggttttgttagaggyggtttgttaggtaataattatttttttagtgttttgataatataaatttgaaagaggagttaatttagaaaaataaaataaaataaaattttttaggggayggygtttttttagttgaagttttggygttatttttaatagtggaaagtygtaaygtttagggtttygggggttgygttgyggatttgggggtagaaagtttattttagggtttttttggtaattygtaattaaggygtttyggatttaggtttatgttgggyggagtggatygygaggggtaggygattagaygygaggttaygyggggagtttygggttaggaggtagagtaggttygggatygtggaagtgagagtygygygtattgttyggaggaagattygagtygygggygttattattttgatttttttatttttttgygattttyggattggatataggggtygggttttttyggggtgtatagyggggtaggttgtgagttttttaattggattyggtttggtttgatygygggyggtttttgtttagtttgtgagggtggagaagggggtgggggyggggtagtggttggaaggggygggggtygggtaggggygaagayggtggtyggggayggtgggagtyggtyggagtygggtaggggaygtggtttygagtggatgggagtgggaggggtgygygtyggggtaygtagygyggtygggttgggttgtaggttygygagtygygggttggggtyggagttgttagagaggyggttgygttataaaagtttgtyggtttttttygtygttygttttygtygttttygttttttttygtttttttttygtttttttgttttttttttggtygyggttyggaggttgtagygggyggagtaggggaggggygggttttygaatatgtagatgagygygtgatggatagttgygygttttaatgtttttyggaaattygagygttttttttttaattttttattttygattttagatttttttaaatttygatygtyggtttggygygyggttgygtttatyggtttygygttgttgtygtygttatygttatttygtygtygtttyggttygygggtygtttaggttagtattygggtyggtttgttttygtyggtygttygggtgttygtygtygygtygygtttyggtygggygtggatggagggygtygygygttttgttygttgttyggygtgaygygggtttygygtttygygtttattatgttttattygtagggttatttgtattaggygttyggttygttggygttttattygtgttyggtttayggygygtyggttttggyggtttygygtagygaggagttggygygttyggygtygggttyggygtttagtttttattygggttyggyggtttttayggygtaggyggttatyggtttygggagttygttgtagtattyggtygaygtygtygtygtygtygtyggtttttygttttatatggtaatygggygygggygggaygygggatttttgggygtygggatttagayggggtttaggyggagyggggttygggttyggygggygggggtygtygggaatgtggygyggttggygatttaggagtygtyggttyggttggtygtttygtaggttgagtygggtttygggtggggagggtagygyggtaggyggggaygtttttgagttyggtygggattygygygtttttygygygttttttyggttygtyggttgattttttttgagagtttgggaagtgygttttygtyggggtyggggtttggygtygtttgtttttggttttygtatygtagtttggggaggygttyggagygggttgtgtgttygtttgtattggygtggggygygagggttygygttattgyggtttttgagtygayggtygggyggttygtatttattygyggggtttagggyggtgggggttatygagttaggtttaggagtygagtatttagttgyggtttyggagttyggttygaggygtttaggtttyggttttattttgtttagyggattatgtttttaaatatygtgtttgygggygygtgattygttaagggtygtttgagtttttygtggttygagygtagtttttgtttyggygatttgggggyggttygygagtttygaggttattgagttgggttaggttygggtygyggygaagtaygttaygggygattgaggttattayggggttgtygygattgtyggttttyggyggaatttttgggtagygatygagtygttggggttttggygaaggttgtaaatgtttygaatttaaaygttaaaggatgaattaaaatgttaattayggygtatttgaagaattygaaayggtgattggtttttgagttgtaaattggatttgtttagttttagagtagtgaatagtgaattgggggttttggggtgtttttttaattatataagggaggggaagagggagtagggggaggtagtygtattttaagtatttgtagaaatttagatattaaagagttatttgtgggtttgtgtgygygtaygtgtaagggtttgtgtatattgttaygagyggtttyggaatatttaggggaagatgggttattttaggaaagtgaaatagtttagaaattygagaataaaatttyggtattttttgtgattaatagttggtttygaattatattgygttttttttgtttttttgyggygggaagygtagttttagagttagatttayggggggaayggtggtygtgggygggyggaggggtggtattttttggttggttgttygyggggttttygtatattttatttataggtttttgttggttttagggygtattttaygaygygtatattatyggtatgatyggygttattagttattattygtayggtagygyggtttattygtattagtttaaygatttygygtatygtaagaaygttaygygggaygttayggttatttttaaggtttggtttaaygagtatygtaagaatttttattttattaagggygagaagattatgttagttattattattaagatgatttttatttaggtttttatttggttygttaaygygygtyggygttttaagaaggagaataagatgatttgggtttygagaaataaaagygaagatgaggaygaggaygagggygaygttattagaagtaaggaygagagtttygataaggygtaggagggtayggagatttyggtagaggaygaaggtgagygggtagyggtyggygtaaggtttyggggygttttttttttaggyggggygtagagttaaggyggggaggaygttgttygtyggatattttaggttygggtyggagttttagtygtattatattgttttggggtygtygggatttgagygagygatttttygggtttttttyggggaggttaggtttygtttgttaygtggtygggtgggggygaggtgaggggtttygtggggagggtttagtgtygtaggatagggggyggagggggttttaggtgtttgygttgttttttygtgttatttatygtgttygygtttttatagggattagtttgtaygtggattygtttayggattattygtgttyggtygagtyggayggggagaagttttygtgtygygtyggggattttttgtgygaatygggttyggagtgtaaggataagtatgaygatttggaggaygaygaggaygaygaygaggagggygagyggggtttggygtygtttaagttygtgatttygtygtygtttatyggtttggaggygtygttgttgagtttttygttygaggtygygtttygyggtggtygtaagaygttttagggtagtyggaygttttygggygygtygtttttygttagtaagtttaagttgtggtygttggtygagatygttaygtyggattttaagtagtygagtttgggttygggttgygggttatyggggttgttygyggtygtygygtyggttttaatyggggtatygttaggaggttygttttattttgtttygtygttgttgggtygttttttttattataygtygtttttttayggtaattatataaattaygggaatttgaaygyggygttgtagggttagggttttttgyggtataattttgyggtygyggttttyggygaggttttgtatatygygttaaaggyggttagygaygygggtaaggygggygygtattygttygagttttattatyggttttygggyggyggttaygagtttaagaaaggtaggyggttygyggtyggyggygttygggaggggagggagagttagtttyggggaggyggagygttygggagattygagggagggttygg

SEQ ID NO: 11305 - DNA, 1059 bp, Artificial Sequence
  Description of Artificial Sequence: Synthetic polynucleotide
yggatygtttttttttattttatttttygggtttttattgtygyggttttgttttattatttttagttgaggggtagttyggagttttatggttttttttttagagyggtygttttttygggtttttttagagttttygaagagtygygtgaggaaayggggatttgttyggggtagtagatttttagyggtgaagaygtagagtatygggttgaygttagaattgaagaaggttaaggtygtagttttygttygygtygtttggtyggtttygtttagtttygttaaggtttttttyggtggagttagygttgygatygtttgtagaaggttgattgygtggtagggggtttagagtaagtygaaggtaagtaygatggygtttattagtyggtttattygygtttygtgtygttyggagttttagygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygtygttagtagtaggaaggttgtgtttgtggttygygaagttttttagtttagtagtgtttygttttttgggggayggtagtagatyga

SEQ ID NO: 11306 - DNA, 1663 bp, Artificial Sequence
  Description of Artificial Sequence: Synthetic polynucleotide
ygtaayggggygggggtagaygtttttagttttagaatttygtygggtttatygtttagtgtggaygatyggygtttttaygagatttatygagggtatatagtttttattttagttygttttattygatttagaygatygttagygyggttagyggttagygtatagygagttgtttgggtaattgtggtyggattttagggagtaagttggtttygggttttatttagttttattyggtttttatyggtttttttatttaggagttggaggatggtttyggggygttttagggggattgttggttttyggagtttttagttagaygygttttgttgtgtgagtygygtgygygtttaatttggaggtagtygttttygtygttgataggtgttgtttagagggygtygggtgyggtttttggygtagttggaygygtaygtttyggtgygtgtagtttttygagttyggttagagagaagagggagttagggygyggtttgggggaygttagtggattggagtygyggagtttygagggaaaaattttgtaggygtygyggtygggattyggttayggttttagtttattttagtaggtgygggaggaagaggtagygtyggagtttygaggttagagagtttyggyggyggyggtygtttttttttttygagttggtttgaagtygttgggtattttyggtttttgttgttgygttygtygtygtygtygtygttatygttagygtygtggggattygggaggaggtgtagtygaagagggaggagaagtaggaggaggaggaggaggaggaggggagaggaggagtagggggtggaggatggagtttygggttgtygyggygggygagttagagtygtyggyggygtttttttttttttaggttyggttttggaagaatttgtagttgggggtgggtaggagtaagggyggygggggygggygygttgggggtttagagygtygtattgyggatatttygtygtttttttygttattttyggtgggtatagggaatgtatyggttagggggagtggtgtaggtagtaggtggagyggttttaagaagyggaagtaagtgttggatygagttttttttttttygtagtttaatttgtgttgttygtygtyggagtttttggagttyggyggygtyggtagagtygagtaggggtttaygttaygtygtyggattygygagtatttgtttttygtygtaaaggggttygyggyggtttygggagtagygggagggaygttttttggyggaygttttttygatttagttttttttttttttttygttttattttttttgttttttttgttttagtttttttygaggggggatygygttygagatgagggtgtayggygttagggtttyggggygtatttgtgttattagaagagtttttttttgtygggtatygtttgtttggagtagttgttggagtygtygttttttttygtagagtyggygyggagtttygyggagtttygggtttyggagaygggygaggagtayggtagtagttaggtgagtgtyggtggygyggtyggagataaggtgygygggattaygtttttttttttaggygtttattattyggggagyggggggygggggtygggaggygg

SEQ ID NO: 11307 - DNA, 2065 bp, Artificial Sequence
  Description of Artificial Sequence: Synthetic polynucleotide
yggagtaggtygaygagagatttttgagaaggttggtagattatygyggatttttgtttttttaygtggagttatgggygaggygtttaagaatttgttgaaggagttygatttttttaagtttygggttaggttttggagtatgaggtygttagttaggaygtttagaaatgtattggtggtggaattgaggatggtggyggttatttgtayggggygtttggtagtaagattgttatttttattatyggtygtatttggtttygtggtgtttygtaggtttggatygttaagaaggyggygtagygygtaygaggagtygggtygtaggtattggtaggygygaygttygttgtgattaygtaygtgtatttgggtatttagaygtattattagtagtayggtagygttttygtggtygtgtagtgtagttaggtgtagyggygtgtagtygtygtgggagygtgygtttaygtygattggtgygttattgygtygygygatttttattagttgtagygttatttygtygtygtygtttttggyggtttaatgtagggtygtgaagttagatatgaagtygygtttggtygttaagtygyggtygygtagtagtagttygtgtagttggtgggtttagyggttttyggtagttygtaygagttattygtgttyggayggttttaggggtatygyggayggyggyggygyggygggtaatttttyggygttagggtttagtagaygygggtyggygygygataggygttttaggtgyggggagyggttygggtttaggtygaggtttagatyggatttttttatygagagtygttttagtagtagaggggagtttygygggttyggttttttygatagttgtyggygtaggtygggttttttygttyggaggyggagygtggygggggtygggaygtagygtatyggtagtatatagggtttttgttgyggyggttttttygttgtttygggttygggtttygygtttggyggattagagtagggygatgtygttttagaaggggttttaggyggtggggtygygtttgyggagggtttttyggtggtttgggttagtttaagggttggaagyggtgggtyggyggatygtttttygggyggttgagygggttyggaggtyggttttttyggggtgttttgtggttttgttggtagatttaggttttttggyggttttattggtygyggtattyggattaagggyggagttttyggggtagaggygtttygyggtaagatygtygaagtgggtttygayggttgggtygttgttttyggggggtygaagggtgygggttygggtttygggggtyggggttttttttttagtattaygaatttgaygtygtygagtttttttattatygttaygttgttgaygaattgtttgaagyggtttttgygggyggygyggtttygygggtygtyggtatygagtagyggtttgaagyggtttagtagttyggagttgygtattttttygtygtgtttttgtaggaagtttagtatygtygtttggtttatttyggtagtygtagyggyggyggyggyggttagygttatggtggggttttgggtttttggttttyggggygggtgggygtygygtygtygygggaygygygggagyggggtttygggaggygyggtygygtttatttggtgtttttttygyggttagtygggygtgttttygaagttggatttyggtygygttagtgtygttgggtyggggygtttyggggygaagggygtygggggtygyggggagygtttatttttagygtttygtygggtttyggttttyggggtaggtttttgtttttgtattttgtttaatgggygtttgtttttatttttygygtygygttygttttataggtgatagttgttttygygatgtagagggaatyggagtagaaattttygtygtttttygttygttttagaattaaaggygtagygttttagttttggtttyggttgttaggtgggtgtgttttttagggaygtygyggttygt

SEQ ID NO: 11308 - DNA, 3487 bp, Artificial Sequence
  Description of Artificial Sequence: Synthetic polynucleotide
ygygygtttttagttygtttttggaggtagttygygggatygtaggttggaggygygtyggygtgatttygatygtyggagtygggaggaggagtyggaggaggttgyggggggtttyggtttaggygaaggaagggtaagaggttgttygatygggggyggygtygggaggtgggtgggtttaatatttaggtygggggaggggtttaagagatatygggaagggtagtygagttttaggggygggtggggtggtagttgtgtgtagtaggggatagggttgggtttttggaagttagagtgaagtttttttggttgtttygtaggtaattttattttttggtagaatagttgygaatygttaagttgatttttttygttttttggtygagaggagaggatgttttaggatttagggatgggygggaagaaattatggggagttataagtttgtatttaggyggggaggaggygggygggygtygtttygtaggygtaggygagtgggtgggaagaagggagggagagggaggaaggaggtgaggtygggaagatgttattgtygggggyggggyggggtyggggattyggtaaagggattgtagtagygttaggtgggggygggggttgtaatgttatttatttgagagttaggtgtgtgygttttaaayggggttygttataagtyggtatttttttggtattatttatggtgtagggttttaggtagagggttggggattgyggattygtttttgaagygggaygygaatyggtagagttgggagaaggtaaataagggttaygttttttgtygtygtttygygggygygtattygtygtttyggtygtygtyggtatatttttatttttttagygtttttttttagttggattatygygyggtttyggaggtggaggttgttttygattttagtttttatttttggygtygaggtttygtattttttatatttatttggaaagggtgtttttygtttttttaaaaaaattgtttaatttgtgtagagtttttaattttaggagtygagtatgttgttttygygtgtagygttygygtgtatygggtygggagagggggygatagggyggaggyggtggttttyggaaggtgtttgggatyggatyggttgtaygtgagtttagygygaggttatgtgtatyggtttagttyggttyggygttyggaygtgttgygtattaataaaatgaaattyggggagataggagggtagatagttttaggttttyggagttttygttygggtygttygatttttttatygtatttatttttygtygtagtttttaygttyggtyggagttygyggggaagttgtagttttggygygttttygttygttygygttttttygtyggttygggggygttttgtygtagttattaataaagaaggtygttaagtttatttttttaaaagttgttgttgtatgygttttttttagttttttygtattgtattttttaaaataygattgattaatatgygtaattttttttttttgtgttgtgtatttttttttttttygygttggttttttagaataggtagttagtaggagagagagggagygagygagtaagagagagygagggagygaagagygttggtagatttgttgtaaaaaygttaaataaygtygtggagatgygtagggtttattygtygggggttggattttattttgtttygyggtgtttttttgaygggygttgttttyggttaygygtygttgtagggatyggygygggaaggatgttttygaagtygggagtttttggggtyggygygggagggyggggggygygtatttattyggggtygyggygagggaggyggtygggttygyggygttttaggttttaygtttttygtyggggayggtyggttygtaggatttaagtyggtgtygttaggagtgggygtaaagtaattttatggaygttatttattttttttaaaaaatagtttttaattgygatggtygyggtyggtattatttattaattttttgtgtatgtttttgtttttttttaaattaagatttttttgtgatttttttagaaaaaaaaaatgtgttggggtgggggtggggtgggggygggtaggaggagygagggagggggagtagttattttttttttatttattyggattttygttttygatattttygtygtygtttttttaatttttygtttagttgtttggtttyggyggggagtttaggtagygttgygggtttygtgggggaagggtgttttttttygtagttttattattaygtttgttggtattttgggttyggattttttatggattttggggygtttttagttygttttgtttttagggtygggttygagyggyggttgygttygtgtaagttttattaggtttgtttatattttatatatttatatatatatttygtttttttatttttttatttatattttttgtttatatttygttttttaygygttttagattygggyggygtttttygtaattttaaaaaaaaaaaaaagygagtttatatttaaaaaaattttttggygttatattaatgaygtatttaaaatttgttatttttttttgygttaaaaagaygtttttttgtaaataatagtttggaggygatattygyggagggaaygaggtttgtattgagtatttygtttttyggggttttagygttggaagattttygttttaggttttgtttttgaatygttggttttaaaatgygaatygaataaattgygtggygttttgtagtattagaagtgagtagaaagtgttggtaggaggggagtggaggggygaaygygagttttggggagggggygyggttttttttttygtatttattttaaatggaaaattaatatttygggygggggaatttgaaattgtaggygattttaagaaaagaggggyggttygtagagagggtttttattgggttygtygtttttttttttttttygggtgttttttggygtttagygttgtttygtattttyggggggtggagaaggtagtgatgagygggtgggtgggtggttgtatattttggttttagtaggattttgtttyggggygatttttttttttttgttttttttttttattatttygaaaggttaaaaatygaggggtaatttttaaaggttggtatatggygaggaagyggggygtttttttttttatttttygttttttygttttttttttttyggttttatttttygatttgattttgtggtgtataaatagtaygttyggattttygtagtttttggaagaagagtttgygttygttaggygggygggttgtygggttgttagtyggyggtggyggggttttgggtttgttttyggagtygygggttatatttatttaattygttgygttygtygagtttattttttttyga

SEQ ID NO: 11309 - DNA, 847 bp, Artificial Sequence
  Description of Artificial Sequence: Synthetic polynucleotide
yggtygttttagtaaagtttttaatttagtygatatgaygygyggygtagttaatgggaggyggagttggygttttttggtygggggggggtyggaggggtgggtttygygttttyggtgtttgtygtgtttattgaatggagagagygagygtyggttagtttattyggtygtttygtgttttagtygtagtygtygygttttttagtttagttttaagtyggattttttygggygttaygttttattgygttygttttaggtttttaattyggttygygggttagyggggttagggggygtttygtatttgggtatttttagygatgygtagyggggtagygtyggtttygtygatggagttgttgttgttgtygtygtygtygttyggagygtttygtttygttygygtttygtgygtttgagtatygagttygtttttttttygygttaatttygtygttygttttttaggtygttygygtttttygygygttttttygggttttaygygttttgtttygtagaggtagttttttttaggagyggggttttgtatattatggttttygggtgggtaggggtyggygtygtygtgygygttygtttggygttggttttggygttggygagygttttgagtgggtttttagtygtygtttgttttattaagtgtatttgtttygttgttagygtggattgttaygggttgggttttygygyggtttttyggggtatttttygtaaygttgagygtttgtgagtatttttgttttattttaygygggttatttatttgggttttatygagggggttttaggygttagattygtttttttttttygg

SEQ ID NO: 11310 - DNA, 909 bp, Artificial Sequence
  Description of Artificial Sequence: Synthetic polynucleotide
ygggaygggggygagattttgggtttttaggggtattgaggggtygtttatgtygggggatatggttatttgggggyggttttygttaatygyggagtggggaaaaggggggagggatggaggaygaaygttyggyggtgtttaaaggtaygaygyggagtaggaattatagttttggtttttagaaagygygygyggttyggggtagaatttgtygaagttttagttyggggygtaagggatgtgggggttattggaagayggggygygggtygttygtggggaggagattggattygaattyggtttattttattygagyggygaygttagygttgattttaggygtgtttyggttttyggygyggtttyggtttaatygtgtaygttygyggaaggtttygtattygygttagaagtggtttgttyggggttatyggttygtaagttttyggtgttttygaggtttttgtttygtttygygyggttgtagtyggygggaggggttgagaggygggtygygttgggatttaaggygtygttttttygttagttttttttttttttygttatygggtggtyggagattygggggtattgttggggtattttaaagtatagggttagtttgagtgygtaaggttttgaaaagaygggggggyggygataaggagtagggaggggggttggaggaagayggtaaagtgatttyggaagggtttaggygttttaagtttatygaagaygggaggtttttagtggygtttggggggattgtgggaaaagtagtttaagaaggggaatttggagygaggtgggggagaggtyggtatggttttttttaggagygttagygttagatagagyggtgataggtygtatygggagtatttygtttatattgaaygg

SEQ ID NO: 11311 - DNA, 2150 bp, Artificial Sequence
  Description of Artificial Sequence: Synthetic polynucleotide
ygtttttygtggtygggaaggttaggtygagyggggyggttagtygggtygggaggagggggtttttygggtygygyggtygtataaagyggggagatttgttgttgyggyggtatgaggygygttttttttygygagttagyggagygygygygttygttttygtttttygtttttygttttagttttyggagygttattygyggagyggtttaygttagtygtygggygtatygygttttagyggtyggggaggtgygttgttyggttttygtaaagttattgtgaatggggagygggtgaygttagygtygaatgttaataatgtagygattgagagtgtgggygtttyggggagagygtaagtygygyggygyggagtaaatagygtygagtygtygtygttttagtagtagtagtagtagtagtagyggtagtagyggtygtgtaygttygggttgyggtygtatagygttaaygtgagyggtygtygttttygttatttygtttgtttattttygtygtygtttygttttygtttttttttyggttttttttygtttttttttttttttttttttggygtattyggggggttgggaaygagttgttatgtgatgygygtttttttygygagttttyggtgatttaygaattgtttatttygtyggttgtygggagggggttgygagtygggaagaygyggggaagaggaggyggaaaaggaygtaaagtttttyggygaggtgagtttygggtttygggtttygggtttygtygttgggyggggtggyggggtaagtttgyggggggagygggygygyggggygggyggggaggygtggggaaayggygygggaagggagtttyggtygtygggygygtagtygtttttttygygttttgttygtttttatggtattttttaggaaygggaagggggtgggagtygagtyggyggtygygtygygtygaatgtgtgttttttttttyggttgtttayggyggtygaggygtattgtattttgttggygtygaagggtgttttggaatagtagagggaggaggagtagagagtaataagttaggtatggggagggygggttgtaggaggygygygttygygygagtygtagtagttgttagattygyggttttgttttyggttyggygaggttygggtgtttyggtttttagtttgygattttagttttaggtygggyggttttttttttaattttyggygtgygtatttygggttgtttygygaggattttggtygyggygtttttgygtttagttgttagtygtygtygggtggttyggattatygygatyggyggggaattaaagtttaagtttagggtygtaggaagaggygagttgggggtttygyggygtagatttggatygaattttttttagygaaagatygggttgtyggaaagygtttygygtagttaagatttaagggygttaggtttttgagagggaaattttgtatttttttttttatagattttttatgaagttaaggtgtaatatatatatatatatatatatatatatattttatattttagtttttaagttttagaagttttatttaggagattggtttatgaaggggatattgtttttttygttttygygtygaggygtttygtggtttygttgtgtttygtttattyggygggtgttygggagttyggygtygttggagayggyggygggyggygtttaygggttattttaggtgtttaygaggggagagattggagygagtatttyggygatttyggtttggttaagtatttgtaggaattyggatygtgaggggaagygtgtagggtygggagtgagtgtgtgaaggggtggtatatttttggtttttggggtygygggygtatggggtatttttagtattttttygygygtaggygagtttggtaatttgagggaagtttyggygyggtygttgtyggggtggtttgtttgtggttygatgaggygygtttygtagtttgttttttyggttatygtygtygtygtgatttgtggtttttaggaaaygagagggatyggggygttttattygygagayggattygtagtttttyggygggttygygggyggygagaygyggygt

SEQ ID NO: 11312 - DNA, 506 bp, Artificial Sequence
  Description of Artificial Sequence: Synthetic polynucleotide
ygttttaygaygtttatgttagggttttttagattagyggagaaattagtagttttggatygtaagyggyggggttagggaggygataaygggaagtttttgtyggattttggatatttaggatttagtgttgttygggygttttttygtagtagttttagggygaggaggatggggggggttttygtaggggttatattgtyggagttttayggattygggygggayggtgaggtttttatattgagtyggtggtaaagttttygygaggatgaaggaggaatttygtgttttttattttattaggtttygtattttttggttttttttgttttaggaatygtttgttttttgtygygatyggygagttttttygggtttttttgaaatagtttygtttygaggttttggatttggaagtttaggggtatygttygggagyggggtatttattgtgggttttygttagttagtatttaggttyggagttyggggatagygggygt

SEQ ID NO: 11313 - DNA, 1503 bp, Artificial Sequence
  Description of Artificial Sequence: Synthetic polynucleotide
ygygtttttgggtatttagaaataggtttttttygggaattygttttygatygggygtttttataatatttgaagttttttaggaygttttttgagttgggtaaggygagaggatttttttttagagtttagtttygagtaatgttygagttygygaggtggggttgggggygataaggaggyggagyggggatttagttatyggggatttttttttaagttagtttttaaattattyggygttatgtatttatagttygygygtagttygtgygttttggattttatttaagtattaggttygattagggtyggttygaaggttatygtttayggttagggtagaggggyggygggaaaagggtttagtggattttyggtttaggagggtyggttagttgttgggtygygggtatttaaagttgygggggttygggttttygattttaygtttagyggggttttagtattygagggygygygttgygattygtagagtagygggtgtagtaggttggyggggttgggatygygagttttgtttgtaaagtttaggyggggtagaygttagggagggggtygygtttaygygggtagtttyggygttgataggtagygaygtattttttygtaattygtttattagtagtttaaagtgtgtattgggtttttagtgaaatgtttggttttgaaagtttagttaatatygggtttagyggagttattagggtygttttttgtttygtagaattaggttttggtttyggttayggtgggggtttygtattagttygataatttygaggttaygygttygaaggattttttgggataagaagtggagtggggyggttaggaygygggtygtggggatygygagggaggagggggyggtygttyggatttatttygtggggttttygygygygggygtttyggygtgtyggattatgtygtyggtagtttygggayggggaayggaggygtttaggygtygggtygygyggaaygyggagtttygggygttygtatgtttttggttttggttttttggaagggttaggtygtygttgtygtygygttttggggttttygtttttttttattttttgtatyggagygagyggggtttttaggaagaggttggttttggtggttaagggtttttttgttaaaagttattyggtagyggttygyggttyggagttttttggggtatayggaggttygggyggtygygttttyggggtygggtttyggggyggggggtgttggggttaaggygtygtaygggygtttaatttyggggtgtygtttttataggttgtggttggggttggggygygggaggttygyggggtttyggagagggaaatttagagaaaagttttttatttggtttggggtygtaggggaaggaagaygtttttygtttgtgtyggygtygatygygggtyggtaggtggggaggtttagagttggyggggagttygttttattygg

SEQ ID NO: 11314 - DNA, 907 bp, Artificial Sequence
  Description of Artificial Sequence: Synthetic polynucleotide
yggtttaygtgttttttattttggttygtagaggtttgagtgttgtttygggtagtttygggtagggttgggtagggtttagyggattttaygggtygttttttttygtttttttttagttatttgtttgtygttttttttygtttttttttttttgaggtgttgtttyggttttyggggygggggtagtygygggtagtttagttygtagygtttttagaggtgttygagttttttgaaygtttygtaggaaagtagttgtgttgygtggagtttttttttygtttyggttttttygttygtgtttttgtttttttygttttgyggygggaggtggyggtgtgggttttyggggaggygyggygggttggggaggtggggaagggtgtgygygtgttgggggtgggggggaaagatttgtygtttttttttttygtttttttagtttttggttgttatgtagtttttatggtagyggtatttttagatttaatttttattttygtttagagttaattaaggtaaaatagtgaggggaggagggaagagygtggttagggaagggaggggggagaggtaggaaatttaattygaagttgtaagtgtagygtttattttgttaaagtygtagtatagatttygaagtygtagygtygttttttttttttttygttttagttygagygggaagyggtagtagttttttagagttttggtttggtagggaggggayggygttygagtagttatattgtagtttttygggtttttttttyggtyggygtaggtttygygtttaygattttttttgggagtyggatttgttttttttatygtygttattygtyggtttttgygttttttggttttygatatttygtttggtygtttttttgtgtyggttyga

SEQ ID NO: 11315 - DNA, 1925 bp, Artificial Sequence
  Description of Artificial Sequence: Synthetic polynucleotide
ygggtttttygtygttttggggttgagtttggtgtygttgtttatattgaataggaygttttttttygtgagyggyggaatygttattyggtaaagygggtgttygaatagtttggttaggagggaggygttttygtyggggtyggggggygattyggatygaygygggtyggggtttygtagtagyggtyggtgygyggggtygtggggttttagggygtygggatttygttttygtaaggygygttyggtyggttyggtygygggyggtagtttttttagygagtgggaygagaggttggaggaggggtyggagttgaagttttgtaggatgyggagygtgtgtttgttgggttagttygygtygtyggyggyggaggaggyggtygggggtttttyggggyggtttygaatttgggtttagtygggygyggttatttyggyggygggttgygygtaygaatagtygggttttttygagggtygygygtygygtygttttagtttgggtagtaggtttagggygatgtgtagygygtaggttattaggaatattattaggatgagtaygyggaatyggygtattagtattatttttatggtygygygggtyggttygggtttggagygygttttgttygygygtttttttagttgtagttgggtaygagygyggygtygtttygygggttaaggtttatyggtgtygggyggttattagtttyggggttgttttygggttygggtygygtgtagggygttygtygtyggagygttgggttttygygttatttygggttygttttygttyggttttttyggagyggtygygtttttagtyggggagtttaggggttttggttygyggagtygggygygyggggggyggttggggtygtagtagggggaggttyggygttygtagtygtyggygyggggtttatygggygtgtgggtttatttyggtyggggygygaygggtttgggyggtggyggyggtygtaggygtttygatttttagygygtttttttttaggygtygggygggygggyggggaaggggyggttttttygggtygggttttgtttttaygtygygttygggagatyggggttggggggaaggggggggygaagggyggaaggggtgggygyggggagyggtyggyggggtttygggtaggtgtagyggtygtttygagygtagttttygtttggtygagtttttyggygtttygygtttygggygggtagatatygagygtygyggagtygtttttygygttagygtttatagattggyggagtygtygttttaygagttayggttgggttygggtyggttgygttttygtttttttttttttttttttyggtygygtttygygaygtttttgagtttygggttygttaaggagagggttttttttgttygyggtttgtagagggaagyggyggagatygggagggygygttyggttttggttaggttagtagttgyggtygagtggggggtttyggtttggtygttttttgggattttttttygttyggggtygtygtygttagttgtagtttttyggtttttttttagaggagygyggggtyggggtttaggttaagttttttttyggagtygyggggygtttgygtygtyggatgagtttttygtygggyggygatttygtgttttaygttygtttyggtaaggaggaggyggaggyggtttygygagagaggtttaaggagygattgggtttggatttaggggaygttagggtagyggagttttyggtatyggtttygttttttttttttygtttattygygggaygygttygttttaattttttaggygtygggttygttgggggygttgagaggggttggtgtgtygggggygtttttttgtttggggtygaygg

SEQ ID NO: 11316 - DNA, 1287 bp, Artificial Sequence
  Description of Artificial Sequence: Synthetic polynucleotide
ygygtggttygggaggttttyggaggagggaagggtttattttagygaggggtataggyggagaaggtgyggggygaggyggtygygggtttttggtatttttttttttaygtttaggttaagttggyggtgttgttggtgaygttggtggtggtygyggttttttatttgyggatggagtagaagttgyggyggggygtggtttygygttagtttygtatttygyggttttagtataaggtgygyggtgayggttatttggaggaggataattyggaygagagygaygyggagggygagtatggggayggygyggaggaggaggygtygttttyggggtttaggtttggtttygagttygttggattyggtygtyggttttgttygtaygaataggygtaggggggygaygggtyggaggagtagtgaggggtygtttggttttyggatttagtttygtttttygtyggttttagtttattaygttttaggtyggggggatttttttygagtttygygttgttttygaaggtttttgtttttttttttttaygttggggaygttttttttagagttygggttattttygggttttygtagttttttttaaggyggagtggagttttgggaatttttyggttaagtataggggttygaaaatatagttgatatttygygggtttttagtaygygttttagygtyggagtagggttagggtttttttgygattyggtttygttttagatttttttagttttyggtygyggattygggtygygtgtgagygttttttgtattttttatttttagggttygtygagagttaygattttttatagaaaatgagygataaagagattttgtattgttttgattggagagttttaggtygygggggayggagygtttttgggatgtaygttyggttggttyggtttttgggygyggtggtgagaggttttgatttagggggatygyggggtgtggggagtgyggagttttattgggggyggggygaggtgttygtaggtttygtttattagtttttttttttttttgaggtttygtttttttatgtttgtttgtttttgttagttttagttaggagaagggagygggggagyggttggtagagatagaggagggtgtgayggygttgttggttttttatgggtttagagggygagatagatttygaaggtatattttttaggggtttgtgtaggtattttyggttttttagygattattttygygtyggatagggtttattttygagttaygg

SEQ ID NO: 11317 - DNA, 2906 bp, Artificial Sequence; identical to SEQ ID NO: 6859
  Description of Artificial Sequence: Synthetic polynucleotide

SEQ ID NO: 11318 - DNA, 2146 bp, Artificial Sequence
  Description of Artificial Sequence: Synthetic polynucleotide
ygaaagyggttttgagagygttttyggggttttttygaagtgtttaaattattagygtggttagyggtttygattttttattaygttttttttygygggtttaaagggatttgggtttygtaaatttttgtygagggagaygttygtygatttygtyggtttayggggygttttgtttttttyggggyggttttttaggtaggttgagagygaaygggatgagtatatttyggaygtttaagggggygtttagygtttygaagtygtygttttggtttgygtygtygtyggtttygttttttygggtaggttggaagygttaggtgttygygyggtttaygtagtagatggygtygtttagggyggygtagyggaagggttgtaggttygtggggtygtyggggaggygtaggggygygaygtaygggttttattgtttggttaggtagtggtatygggataygttgatttygttyggtttygtygtttgygtttygtygyggttgtygtttagatygaagyggtagatgaagtygtygagagttattatgtyggtygagygttygyggttgttgttgtaygggtatttttgttattygtygygtygygggttatatttgagtaggygatagaagagggagttttyggataygtagatttygtygtggtaggtggtggttttatgygttayggygaaggygtttyggggtagyggygttaygggggtttagyggtyggygygygggtygtagygttttaygttgagtaggtattygtygtttayggygtagaggtgatygtttagggttagtagtygtagttgygagygygtttggygtaggggttttayggygttttagttgttygtggtygggttgtagtagaagatttggtyggaygggygygygyggtygtyggggttygygggygttaygtygttygttaygaagaggtagttgtagaggaygtataggtygtagtttygygtyggygygttttygggtagtygygttagttygygttatttttyggtygtygygtggaagtagtagayggtygygttttygygygygttygygtttttygaggggttttgaggtyggttgttygygygttttttygtyggttygagygtygyggttaagaggtgggygyggtyggygygtaggyggyggygtagtagtaggtttygttttgygttygataggyggtygaatayggygggttygygtagtatttttagatagtggtygtttatgaagtagtaggyggygtygygtagttygtttagtygttgtygtttggtygygtttaggatttygtagtagttggttaggtttagttgyggttttayggygtyggtggygygttgygyggygtygggtagttgtaggyggygygygtyggttattatttyggttaygttgtygggtygtaygttygttatgygttygttgtaggygtyggygaggagtagtygtagygtygttaggtttattttttgtattygtagtaygtttygygaygygygygygyggaagtagtygttgygygtygttagtatygttttgtgygygygtagtyggygtttygatatttttagtattaggttyggtttttygtatatygtttygaatttygggggtaygggygygggtttttygggtttttygggggaygyggggtttttaagttaaaygygyggttygggggayggygtygygggttttttygggtaygygygttttttaggggaygygagttttttyggggaygyggygttygygttgtyggttttttattgtygttttattattygygggttatygttggagggyggggaggtggtygygtttttygtygttgaggygagggattgyggyggggattttttttyggagttgaagtatagggaygygtygagattgtagggtgtttgygtyggggaygyggygttttygttttygtttttttyggtagtttygggtttagtttttgggtagaggaygtagggggttatygygtgttttatggtygggttgtgttgygttgygttygygygttttyggtttygtagtttgtaggtttggttaaggtygagttttatttyggggtttttagttttatagttttttttggtaygyga

SEQ ID NO: 11319 - DNA, 865 bp, Artificial Sequence
  Description of Artificial Sequence: Synthetic polynucleotide
ygggagtttttttttttygtgygtygttgttygggaygagaaattygtggggtatttaggattaggataygaggttttagtttgggtaggtggataagttgtggggttttatttttygtaggygatggttttttaaagtttgtataaatyggtttygtygggtyggttatgttygttttttttttyggygtgggaagtttttttaaaagtggaggggagygagtgtygygttttgttaatttygattgygtttgggtttttttygygtygggtttyggagtygttttttttgattttgygattayggtyggggattttgygygygttygggaatgtagagtttttagygtygygtagggttygtttygatttyggtyggttttgggtaattygtttygyggttagtttttattttaagatgtggttyggtttttattttygygggggggaaatgtygggygatttttatattgatttttttgygtatttagygtaaattaygaatttagagttggagttgttygtagatttygygtagttagatttygygtttttatttygtttygtttygtttygtttggygtattaattttyggtygaggaggggtygygtggygtygyggggggygggtygygtaygtttttygtagggaggatttagggatagttagggtttygggagagttygygygtatygttyggtttygyggygttagttatggygttygtgygtggtttygttagggatggggygaygyggttagagtygtaygygatygaaattygtattttggagtygtagagygygyggttttgttgtttagyggttttttggtaagtgaygtggggaagaaaygtagggygt

SEQ ID NO: 11320 - DNA, 865 bp, Artificial Sequence; identical to SEQ ID NO: 11319
  Description of Artificial Sequence: Synthetic polynucleotide

SEQ ID NO: 11321 - DNA, 1463 bp, Artificial Sequence
  Description of Artificial Sequence: Synthetic polynucleotide
ygtaatttggggttygtagaygygygtggatataaaaatataygttttygagatttatttttttygggttatattgtggggttgygttyggggtaygggttatgtttgaatttttttttatygtygygtttygggttygygtttygtyggtygttygtattgggtttygygtygttttygttattatatygagtygtttagtattttttttttttgaaggttggtttygttyggggtgttttttttttyggttttgtygtygttgtttattttttyggttttttttygtygggtygggtagggttggggygyggggttgggygagggygygttagtttattggagtttttttygggygtyggggttttttygggygggygtygygggttgtggggttggagttggagtyggggtagtggttgtygggttygggttgggttggggttttygyggygagtttgygayggyggyggygggygatttaggaagtgtaagggagagayggggtagggygygggtygggagyggggtatygagataatygggtttygggagggygatttggagagggagggygggagttaggggaggaaggaagaaggaaggaaggaaggaagtaaaggatggggygaggaygygygttttaggagtaagygyggagagttggggttgggggttgtagtygttggaaggaggggaygggggtgtttagagaggaggaggaggaggaagaggaggaggaggagyggggyggaggagygygggtygyggttgggaygttgggattygagagtygttgagtaygygttttaggtaggttttgggaagttygggatggaagtagttttttttttttygtttttttttttttttttttttttttttttttttygygtttttttttttttttttgttttttttggaygtgggttgtyggttgtagttyggagggayggggygygggayggagtttttygygggaggaggggtyggyggtyggatggygygygtyggggaggggtagygggtygygggyggaagyggygattttagttttygatttagyggttggtyggagggygagggttygggaggtygagggtagggaggtygggtttygtygtttttttggttttygggggtttyggygtttgygygtttygggatttyggggattttgtttygtyggggtttggatygggatttgggatgtgtgygatttttagtttgtyggtttttatygagggatttgtatttttggttttaagtttatttttttygagttagattyggttttttttttgttgtttgaatgatagtatgagaattygagggatatyggggatagtttatttygggtyggtttttttaggatagggttttaaatttatttttagygygggttttgygaygygttyggagtttttttygtttygttttttgagygtttygyggtttttyga

SEQ ID NO: 11322 - DNA, 1437 bp, Artificial Sequence
  Description of Artificial Sequence: Synthetic polynucleotide
yggtttttyggagttgaggtttgygygattggatttaggggtagaatgagtgygtygggaattttaaaattttagattaagatataaggggagtygayggttyggaaatttygttgygggtgttttaagygygaggtygttygggtagggtygtttagggatyggggygttgggtgyggggtayggggttttatttttygygggttggggygygtagygygyggtttttttaagaaagttygtygggygagtttattaaagtttaaaaattygtygtggagaagggygygggggaagaggagagagggagagygttgatttaggygagagagaggggaaaggttyggtyggaggtyggygtttygyggtyggggtyggggygagtttayggtgggyggtggggattggttgygygttttttyggagatygygyggygggygggggagggggttggtygggttttagttgaggtyggtttyggtttygtttttygtygtyggygttygttttttttttyggygttygtttttygtygtygttgtygtygtygtygtygtygtggygtattygtyggtygtagtgaaaaggyggaggyggyggttttttyggtttttattgtttttttygtygtattttttttttatttttygtattygttaaatttgatgtgattttggttygaygyggaggttgttttttttattgtttygtgggtttttygttattygtttygtattygygagygtatygtttttygygtttttttttatttttygyggggtyggygtygygttygttttygygttttttttygtygttttttttttygtattatgagtaatttgaagtyggayggygagtayggyggtagtatyggtatyggtttyggygygggtttyggyggygttttggaggaggaggtgggtttgtggtttygggatttgtygggtgaagygtaygttaggygggygygggagagggygagyggggtttgtygygtttygyggggtyggggtggttatygttttyggygttttttygtygttgttttttygttygggtaggagyggttygtgttygygggygggagygtgyggtttggattgtttygtyggataggtattgttttttygttttttygggttygaggygggtygygygygtyggtygtygttygggygtttygyggtgggygagatgygtygygttygttttatgtttgtygttygygygttttttgttttttatttygtagtygttygtygttttttttygaggygtattttttgygtggttaggatttygtttyggyggtayggagyggagygggattagtayggttygagggyggtatttttattttattgtttttttygttttgatttttttttygtgattttggaggtttgggtyggtyggtttttyggtttttgyga

SEQ ID NO: 11323 - DNA, 717 bp, Artificial Sequence
  Description of Artificial Sequence: Synthetic polynucleotide
ygaggagaaaggtygttaaayggagygagagtttttatttttatttattttagtgttatggtggtatatgtygattattatttgygaggttttttygtagatttgttttttyggtttygtagygyggaygattygtagygttttayggttatggttttttttataggggtgagtttgtttttyggatgggtggtgaagggtgattttggatttgatttttgaatygtagyggtttgtayggggatygygggygtgttgattttatgtgtttygtttagttgttgtagagtyggtttatygtayggtttttgygggaggaggttattttggagygattttttatttggtagggagatttygaatttattgtgygttggttgggtttgttgggtttgggttatttygygttgaatygtaggaaggtgtgagagaaggggaggggtggagaggggtttggttyggtygyggygaggtttgtaagaggttgatttygagttttagtaggtgyggtaygtgagtaygttgttgtyggygtttttgggygtattgggygaaggygaygygyggttygtgggtgtagygttgggygttttgaggaggtttttgttgyggtttygggygtttgtgyggtttttgagygyggagttgggatygygttttttttygttattggaygaygtgagtaaaygtttygttttygggtttygtttttgtygt

SEQ ID NO: 11324 - DNA, 1713 bp, Artificial Sequence
  Description of Artificial Sequence: Synthetic polynucleotide
yggtagygaattaagttgygtaggygttttgtttttttttttattaatatgttygattggtttaygattgattatattattggttygygtaattttagtaggtttttgggtttgtagttgagtygaagtttttttttttgygtagyggggyggggtaygatggtggyggggggggaggggggaattgttttattaygtatgygtatyggggatggygatagggtttttttttttgtttttttttatagttttttttagtyggggggttgagtgtttttttttttttttttttgttttttttttttttttttttttatygtttagyggggtttttaattgatagttgtygtygggtttygttygtgtatygtttttttttgttygtgtttttygtaggtagaggggggygggagggggtgtgagggagaggaggagtyggagtygtygttgyggtttttttyggggaggggagaggagaatttttttttttttygtttttttttagtttttygttggttygggagggggtggggygtygaggtygyggygattyggtagggtttggtyggtgaagagtaggygggyggggtgyggaggggtgaggtyggygagggtygtgygygygtygtygtygggggggaggggagaggagggtatttaggttttttttttttttttttttttttygygygttatgtaatttygtttygtyggyggtgagtttaagattttygygygtatygagtygagtyggyggttgaggagagttaggttygatgtggygggggttaygygtygyggtygagtygtgaggaagyggttygygtttaygygttttttagtatttygagyggttgttttatatygtttagtttaggtttgtyggggtatgagtgtgttygggaygtygggagygatggagtyggttggggaggaagagyggtygttatyggyggtygaaggagaggaygaygaggaggaggtggtagyggyggtttagattttagggtyggtttayggaaggagtgttttttygttggaggaygyggaygattaggaggaagagatggaggygatggtgatyggaggyggttgttgtaaggagtaggagttgatttaygagttatagtagggttatygtattttgggygagtttttgtaggagaagtatyggggttttatygttttttttttgtagtttttggggggygttgttatygyggaggaggaggtggyggaagggtygygtagygggggtyggggyggtygygttttttygtagtagttyggatagggtatgtgtttgttgtagatggaagagaagttygttagyggttagtaygggggtattatygagttygtggyggattttaggttgatgttggagaygtgttatygtttgtayggagtggattattggatttttaaatagggttagaagttggagatgatgttggagtagaagttagygtttttttttyggtaagygagttyggttttyggtgggattgatagattgatataaatatatatttataygtgttygaggatgggttgggttaggggtttgggggyggygttgataggtgttgagtyggtgttggagaagttygggaggaggagyggygttgggyggggatyggaggggtgtggtgggtgtgggtygaattyggtttgygygtagattgagaaggaaattygagtttgtagygt

SEQ ID NO: 11325 - DNA, 699 bp, Artificial Sequence
  Description of Artificial Sequence: Synthetic polynucleotide
ygygygaatygttttattttggatttttggaatygtgtttaggtattygggyggyggggttygtttaggtygygttaggtagttttgggtyggtgggtgtygggtttttttttttttygttttatttggygygttygtagygtygtygtygtygtygtttttttttttagygggygttyggagtatttygygtygygtttttttygtttyggttttygttygtyggagyggggtttaygtygttggtagttattaagtggttygttaaggaaatgtaggtgagtgygtgaggtygagyggtagttgttggagaygtggggtgtgtgtttgtgagtgygagygagaygaggagggagygttagygagygagygagygagtgygggagyggtygtttyggtttttygtttagtygygttygtagtyggyggtyggagygygtgggggtagygtttygtttygatagagtttygttttttttttgtygtttyggttgttttttygaggagtygggagtygtttatyggtttttttaattttgygttttttttttagttygagttttttygttgtttttttttttttttttttygagtttttttttttttggygyggygtygttagttagtttyggyggggagagtgtaggtattttgtttttagaataattagtaggatttaagtyggtttttygagygygt

SEQ ID NO: 11326 - DNA, 1191 bp, Artificial Sequence
  Description of Artificial Sequence: Synthetic polynucleotide
yggagygggygaggayggttagtttttgtagtgtttaggtttgtayggaagygttttggtataatttagttgaggatataygttttttttygygtagtyggagggttgaatagtaaagtatttttygggggaattgtgtgttagygtagtttggagagagtaggtttagggggtagttttattataggagataggataygttttagtttgggtaaattttyggttttttttggttttaagttagtagtygtygttygygatttttttttttttttygtygttatttyggtygttttgttagtttygaatttgttygygtttggtygygyggttttttagtttayggggttggyggygyggttgggatgggatygatgtggygtatgygtggtggygttattaggygygggagttgttgyggyggggayggtgttgyggayggtygagggttaggtygtttyggtygggtttgtggtgggggtagttttagyggyggyggyggyggygtgggttggygaggtygygyggayggygttygatagtagttggaggagyggtttgtygatttggyggygagttatttggaggttattygtgygygggaygagtgggatyggtagaaygygyggttgygttaggagaaygttyggttgyggttygagaatyggyggttgaagygygagaatygtagtttttttygttaggttttgyggtttttyggygaaggyggtaaygggaygttygyggaggtaygtygggtttttgaagaggttagtaygaatyggagggttagagatagyggtygagaggaygagtygggtagttttagggttttgagggttygatttgagaagttggaagttatgtatygtygggttttgttgtagttgtatttygagtagyggggattaygttygagyggggataaggaggagtagtttttataggaattygatttyggttttygttttygggattyggagttttttgggttttggttgtagtygaggtygtagtyggtgagaggyggagtttygagygggttttttttttttygtttttagttattttygatttygygtaygttttggttygttttttgttygyggatattttggattayggtgttttttygtttttattagtggatattttygggtggygtttggttattygtttggtggaggtyga

SEQ ID NO: 11327 - DNA, 536 bp, Artificial Sequence
  Description of Artificial Sequence: Synthetic polynucleotide
yggaygggatgtaaagtttgggtgagayggttatyggaygtttattggaagggtgyggggatttttaygtygatatttygttttttygttttagttygygtatttatygygtaygtagagtagtgatatggtygaggatygggtaagtttttgtygygttttagtygygtyggatygttttttttttttttttagtaggtgtygygattgttttygttatyggttttaygggtttggtagttttttatggtttyggtygtaggtagygtttygtygttgtttyggattygttttaaattttatygtttgagygaatttygggtagyggtgagtatyggtyggtaggttggggattgggygyggtatagygaygttatygttgggaggtaggagttgtygggattttttttygttattttattygggattygygygagygtttgggyggagttaattygtggtgtttygttttttagttaattaatttaygtttagtttatygatttygttttttttygygagtaygtaggaggygg

SEQ ID NO: 11328 - DNA, 728 bp, Artificial Sequence
  Description of Artificial Sequence: Synthetic polynucleotide
yggttaatayggttaggtttttygggygttttaaggtttygttaattttggtaaaggyggtgttgaggtgaattaygtggatttgaaaaggataygagggtaggagagggttaygtttttggtttygtttygtttygtttttttgttttttttyggttagtttygygtttatttyggtagggaaayggtggttttttatagtgtgtttygagttyggaygatttgtagttttttagtgtagatgtagttgtagagttyggtattttygttygggatttagagttatttttagtttaggaggtagggttagttgtattgygtagggagaggtaagtgagtyggtttygttyggtagggttagtttaattttygggtaggtattgtygygayggtttttttttttgygtttygttttatttttaagtttyggyggggagatttttttattattgtggttattgttgygtaggygtagttttgggagyggygggagttggaagtttaggagttttagggggygtagggtygggtagaaggyggygagttgggggyggatatttatyggggattggaagyggttygygtaggttggggatattyggggttagggygggtygtttggggtgggagagtatagtgaggaagtttgaygtttaggttaggaatttagggaattygggtagaaaaggtgagggggtgggayggtgggyggygggtgggaygttygg

SEQ ID NO: 11329 - DNA, 1431 bp, Artificial Sequence
  Description of Artificial Sequence: Synthetic polynucleotide
ygagttaygttgtttttttgggagtttatygtygaaattaaagttatttttygtygggagtaggtaaaaggatgaggggaaagaaaattaaygaattatttttaggaattgaygtttttgttaatgattyggaagaaataaaygtagttttttygtttyggttttgggttagtttaygtgatttttttgggaggttaaagagtatygttttgttttttttgttgttaagttaagttattttaygyggygtagtttygattttttyggtttygygtagttttttttttaaattyggagaataagttttatttttttygaaatgagaatttttttattggttygaatgtgtagtttattaaattaaaggggyggggaatttttgtttttattggtttttttttttygtaattttygttttttgttgagygagtttagtttttttttgagtttagagygttttttattttgtygggyggtttttgattggtggaagtgaggtaaggttgggtttygttttttttttygttygttagtaggttggagtyggggttagttttggtatttttttttagttagtggttaatttttggtttagtggggattgtgttygtttttttygtttttttttagtttttttttygttatyggaaygagtttygygtttggtaggttgaggaggagtaaagaaagtaggattaaagagaaggaagatttggttaggtttgggtggygtttgtagtgttagaaagggaggyggtggyggyggyggttgygattayggtygygygggaygtgaggttygagagtaatygaygggtagyggyggtygttttagygtttygtatyggggtygttagttagtagaaygygagtttttgtggaggagtagggtyggygygaggygagattygggagygtgagyggggtttttggggygtygtygttttttttygtttyggygtygggggttgtagttttggttttygtttttttgtygggttagtttgtaggyggagagagtyggayggygttyggagygyggatttygttttgtggaggatagygygtyggttgyggttttttttygattttttttgttyggygtttyggttygggtygtttaggtgtaggtgygtgyggtttyggggtttggggaygtygtagttyggttyggggagggggygttaggtygggagtygtagygygggagggaygagttygggtyggyggggggaggggagygggaagygtttttgttgttggygatygggattttttttyggtataggggaaaggyggggaagttattttttatygggtttgtgtttttgagaggattttttgatggttgygtgaaggggagyggtaggatagtttttgyggttygtggagyggtyggagttagggggtgggggagggaggatygatyga

SEQ ID NO: 11330 - DNA, 588 bp, Artificial Sequence
  Description of Artificial Sequence: Synthetic polynucleotide
ygatttattttgygagttygggtgggagttttaggtttgtaggggtygygtggygttatttttygatygygatttttaatggygagttygtgyggtttttagtgygtygtttttttttgygggtyggtggggtttgygagaattyggggttgggggygggtttggtagtggygggyggggatttygggtygggatygagaagygttttygaayggtagttatattggggttgtttagtggtttgagtttttttttgttttttttttatatttttttgttttggygyggggggttttygyggygtygaggtttygttgygtygtttattyggagggaggagggtttttgggaggygtygygtgggggygyggttygtggagttygggygttagggatyggtyggggtyggygtaygggtgygttttgggttygttygggtygtgggagttagggagttagggagttagggatttyggttttygtayggggtagataggggtagygygggygattyggagygtttgygttttygyggttttttttttaatagggtaaatttaggggtttgatttygygtttgttttgygg

SEQ ID NO: 11331 - DNA, 1203 bp, Artificial Sequence
  Description of Artificial Sequence: Synthetic polynucleotide
ygtttttttgaagttygttttttagyggtttggagttyggggygtggtyggttygaatttgttttttaggtttagaayggagttygtagttygtaattygttgtggtygtagygggtygygtttttygttttygttttaggagyggtygaggatttgtttagttgygggygttaagttttggtygtattttttttttyggyggagggagtyggttggygttgyggtttttaaggygygyggaygtygyggagggtagttagtygygygggagygggtagygygygygagggygttgggygtygtygygaggyggggaagygyggggtygyggyggtgygggttttagggyggyggtygtygtygtygtagtagygtttygagyggggagggtygaggaggttygaygagttggggatggagagtatygggttttttattgttttagagygygtgtgyggttttgggygygtatagtgayggtgayggtatttttggttyggtagygtygaggtygtttygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtygtggtttttygggggyggtatygttaggtgagygtyggtyggggygaggtygggtttygggyggtaggtayggggttaggtggttttgaaatttggygtagtygygagtygagattttygattyggttagtygttygggtatgttattgtgygygtagttygtttygtygtttgttttggttttgtgagggttgttgtgaggtttaagtttttggtagygtttygtttatygatyggttgttgttgatttttttgtgtgttyggggtttatttygyggttygttygtaggagygtttgtatttaggttattttggatttaaaatagayggtattgtatygtgtagattygagggttgggygt

SEQ ID NO: 11332 - DNA, 5370 bp, Artificial Sequence; identical to SEQ ID NO: 6909
  Description of Artificial Sequence: Synthetic polynucleotide

SEQ ID NO: 11333 - DNA, 1691 bp, Artificial Sequence
  Description of Artificial Sequence: Synthetic polynucleotide
ygagaataaaygttagtttttatttttgtggaaygtttaaygtagttggttgggggaataygaggttttgtagggagygagtttyggtttyggtttgayggaatataggygaygtaygtgaagtttaggttttattttagygtaggygggtttttagygatttatagttgttatatattyggttagygtygattttygaaggygtattttttatattttatttygagtatyggttttatygttagggaaggtttttttggatagtaaggtyggggtttaggatttgygagatttattttattygtttygttagagtttaggagtagtaataggtttgygtttttttygggyggygttttgtagattttygaygggttaagggtgtttttagtttagtygtgygtttaggtyggggagatgggyggaggattggggttttygatttttttgatagtttttgygygttagaaattgagtagatayggggttygygttatttygttygtygtttgttttatttygygaggttgygtttttattygggttygggagggtyggttygygtttygggtatgaatggggtttttttttttaatagyggggaaatttygttatygttttttatttyggttttyggagttygyggtggygtaggtttgtttagtaagtttttgaatyggtagataaaggggtatyggaggaaaagtygagygtttttttaaatttatyggttatttttttttttttaaaataaaggagtttttygtygattttygttttttttygtaaggygygtyggtatttyggggagyggttatttyggggtattgtttaggtttttgggagygygtygtattttagttygagygtygyggggatagttggygatttgtatttataggagttttaggggygggtggagygttygggygtttygagtygtyggtyggattttggagggttagygygggattygttttttygtagaagtttgyggatttygygttyggttygtygagttttgygtatttatttygtygygagtagygtaatttgtggyggygtygygygttyggtygygtttygaatttttttttagtyggtagttttygagtttyggtygtgyggyggtygaagagggttyggygtttyggagtagtygygygtygttttygggtygttttygtttygtygtygtygagtttyggagagagygygggygttggaaagtttyggtggygaatggyggtttgagggygttgyggyggyggyggggygggggygttggyggtttttygtttttaagygyggagtgggggygttgaggygggtgyggyggyggyggyggyggtagygggagagggygggatagygggagggattggtayggatagtgatttttayggggagttgtygygagygygyggattttagttaggaggatygttaggggttygttttygtygtyggttttttttttayggtygtgggaggggattyggygtattattyggtttygtttttgygtttygggggagtygygtttygaattagttttttttttaygagggtagggatttyggttttgtttttttttygyggtttttagtggggattygygttttaatttagtttttgttttayggtygggggattagygtttttattaagttygtttygtttttttaygt

SEQ ID NO: 11334 - DNA, 1223 bp, Artificial Sequence
  Description of Artificial Sequence: Synthetic polynucleotide
yggaatgttatttgtttygattgttttygggtggttataggygygggggaaggygtagggttaggggygttgagggtgaaayggtttyggygttygggyggyggyggtggtygtttgyggtagtttagttgaaaygtagyggaaattgtagttagttayggggttgygggaggtaaggtaggaaggtggygttgtygtygagygtttggagttygagygtttattatggyggtaagggtaatggtygttayggggagygagtaygttttttygygygtataygtygtygygtygggttttyggggttygttatyggygtygttgtygtygtygttygtttttttatttttttttaygggttgtagyggaattttttttttagatatygtttttaagatggyggttttttttttyggtaattttttttatygttttttgtagtaggygtygagtygtygttattttgtttttygttttttttttttttttatygatatttatatagygaaaatyggttyggtyggtttgyggtttttattttaygtttgtagttttygttttttygttaggttttatttyggygyggtgttttaggtyggtygyggagtygattyggggtttttygatygttttyggtataatygggygatttttttttaattttygttygtttayggagygygttttygtygtygttyggggtagtygggttttttttygggtttaattgyggttttttyggggtttgttyggygtygygygttaygtygttyggtttagygygggagggygttttgygggtygtygattaggtygagattaggtygttgtgygygtattaggtttygyggtygyggyggtattygggatttatyggayggaygtgygggyggtyggygayggtggygggtgttgtaggtyggtttttttttggagtattgggtygggtttyggttggtggggygggyggagggagggaggaggggtygagttyggagttgataaaaagyggtttagtttttyggtaygggttygtygttagtaygttaygttatygttygggagagagatttaggaaaatgyggaagggtagataggttttttttttygttyggtgggtttttttggtatttygtgtyggygtygttttygtttygygatyggggagtttagtggtttygttgyggyggggttttyggyggtyggagttttygtgatagygt

SEQ ID NO: 11335 - DNA, 1103 bp, Artificial Sequence
  Description of Artificial Sequence: Synthetic polynucleotide
ygaggtaygtattaggggggatttygtattygtagtttttygtttygtatttygtagttygggayggtttttggttttyggttttagygaggtygtygaagtygtagtatttagttttggaaggttaggtagtygggatygtagggattagtttygagyggyggyggyggyggggtagaagggtagtygttttttygggatttaggaygtyggygggygggaggtatataygygygtataagyggaaagaaagygggtttattgygtggggatgttygttygygtagttgtttyggyggyggyggtygttgtttgtatygaggtygaggygyggyggtggyggyggyggttgyggattgagtttttttygtygggyggtggatgtagggygygggaggggygygaggggaggggtgygygtttgggaggyggggagggaaagaggggaggaagtaggagygygggggygggygyggttagttaggggyggggyggggygygygyggggtygggttttgtttattgtayggaggttgtgtgyggggygygygygygggagayggtyggaygggygtggggagaggggyggtttgttaygtatttygygygtttaygtgttttygttattggagagggtygggtaygyggagagggtggttgyggggaygyggtggtaggttttttttygaggatyggttyggattygaagatygggaggagggygggtygggggygtttygggttttttttttygygtagyggtttttagaggtttgygggagttaygaattattgtaggyggttggggttggggaggtgggagtaataaagatagttaagtgagggtggygtttygttttatyggggttttygttaatttgygtattttttgaaaagyggtttygtttyggggtttaygtygtttyggttttygatttyggaattyggtggtttgtagyggygtygaaaggtttatygaygatttttttttttagtagtaagtyggagggagttaaataagttttatttataattttagtgttattatttagagygttttaaygttatttagaaagtatygatggtaaagyggygygtggygt

SEQ ID NO: 11336 - DNA, 616 bp, Artificial Sequence
  Description of Artificial Sequence: Synthetic polynucleotide
ygtatttaatggygattygatagttttatttggtatyggtgttyggttygtggggygggtggagggtygggtagtygtagggygygggttttttygggtggayggtgttyggtygggtygggtygggtyggggaggtaggygyggggygyggggygyggtgtatagyggggagygygtagggaggygaggaggygyggattgggtttygttygtaggagaataaataggtttttttyggtygttyggagtttygtttttygttttttttttyggtyggtttttttttttgttttttttggggtaggtagaggygtttggtatatttygtatattttttygttagygtttttygttygttygttttttttyggtttygtttygyggggttgttggagaaattaagtttggggttttttttgtygagtayggggygagttttagaaggttttgtygtgatggaaaatttttaggtaaattttttygggttygtggtttttaggtygggaagttttygttaygtgaagggttttygtttttagttgygygatttggtttyggtatagggttaaygatttttatagatgttgtygggttaatttagtygagaattatygt

SEQ ID NO: 11337 - DNA, 206 bp, Artificial Sequence
  Description of Artificial Sequence: Synthetic polynucleotide
ygttaaaggygaygtgtyggtygttagttttaggtygagtttygagygtttgtaggaataygtttttttattyggygygggaygtagagttgygagagaattttgtttagygyggatttaaygttagggygtygtttagaggttggtttttgtttyggttttattygtygggagattatagagttgtttttttagtygttygtygt

SEQ ID NO: 11338 - DNA, 1141 bp, Artificial Sequence
  Description of Artificial Sequence: Synthetic polynucleotide
ygtattaattggygtgtgtaggygttgttgtttygygttgygtayggagaagygtttygaatttatygtaygatgyggagttaggggtagygagtgagyggyggtttttagtttttttttgttttttttttgttttttttgggaatggtagggggttttttatgataaatgttygtaaataggatagggttyggaygattttagagtyggygttttttttttatatttttagttttagggtyggattygttttygyggttgttatygtttttgtttygggygtttygyggggattatttygttaggtgagygtttttaggagtttttttgaaatttatttgygtgaagtataagtttattagygtgagggtgaaaaattgtaggtatatagggaagtagtagagtagttagaagaygaaggggttgagygaattggtygttaygaagtttttgaagtagaaggagaagaggayggttygtagggaggtttagaagaggtagagaaagaggaagaygttttggtagttgagtygtttgtggyggtaaygtagtattagttagagttgtaygtagatgaataygaagagtagygygtagaatayggtgtagaygayggtgaggttaagttttaygtaggggggtayggtyggggttagygtgggyggtagygagtygttgygggttgggttttayggyggggtttttatygggtygggggygttgtygygyggtyggggaygttygggttttatyggggtttayggtygtygtygttttygygggggttttygygtatygygtttagtttgtagtttygagattggaggaaagaaaataagtygtattttttttttyggtattatatgatttattgggayggtttttgtttgygattggtagygtygygttygtygttttygygygtygatyggtttygygygttttygtttyggttygygygttttygtttyggttygygygtttyggttygttttttttygggtatygygygttttygtttygygaatttyggttygttttattttygttatygygygttttygtagtgygygtttttagagtygtaygttttttttyggttttttttttattttyggggtygygygtttttagattgygg

SEQ ID NO: 11339 - DNA, 1819 bp, Artificial Sequence
  Description of Artificial Sequence: Synthetic polynucleotide
ygyggaygtaggaygtagagttttagtatyggtagttaagaggaygtaggaaagygtaygtatttataggtttagagaygyggaygttagatttaggtttggatagagtagtttygtaagttttaatatattttgtaaatttygaagataggagagagttaaaatattttttttgttygtaygtaggttttttttgttttttayggttygattttgggaggyggatgaggatatttttaggtttggatgggggttatgggatattttattttagattttgttaygatttgggttgtgttygttyggtgttttyggtttaygggttgtataatttggyggtttygaaattggygtgggggaggggagggttgtttattygagtaggaygyggttgtttatttagtyggaggtgaggaaygatttttttatttygttgtygggtttaagyggggttygagagtygtyggggagagttaaagggaggggatygatggattttttagagtgaaattgtgygttttggagagtttygaggtagtttygygagttttygaggaggtygttgtygtttggtaaatataaataataataaaaggaaggaaatttaggyggtagtgygtagaaygagtatagggttttgtgagggygygtagggtttaygygggtgtttttaatagggttttttaygtaggyggygygggtayggggtygggggygygyggygtttttagygggagggygtttggattaggggtttygtttttttttagygtattttygtttttttttagygtattttygtttygygttaggtttattygtagggttttttttagtaygttygyggtygtagtagttagtttagtatttattttygaagttygaaatgattttatttagttgygygttgatygyggggttygatatgatggttggtgggtagygggtygygyggagggtagyggygaggaagygttttyggyggggttygggttttgygygttggttggggygtygygttygygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgttagagaagttagggaygggygaygt

SEQ ID NO: 11340 - DNA, 1813 bp, Artificial Sequence
  Description of Artificial Sequence: Synthetic polynucleotide
ygagtttattttattaaygttaaattygttagtttygttagtyggttgtaggatygagggagggtgtaaaaggyggggggyggagggggggtagattagattaggygaaatttaataagtttttagttttttagtttaaagtttttattatygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyggtttagtggtttttgygygtyggagttygtygygaagattgagyggtygyggggatygtygygggtttygygygtatttttgggtttaatattgttattatttgatataataggagtagtgtygggggggtattgygygtttagaygtgagttgtgataggttttygaaattgggygt

SEQ ID NO: 11341 - DNA, 1872 bp, Artificial Sequence
  Description of Artificial Sequence: Synthetic polynucleotide
ygtggatagaaagtaygygtaaggggtttyggggataggaagttattagtttggggagygggaggtattggatattttttygtttygyggtyggtaygggtgygygtgyggtagyggyggtaggggtttttygttttgttyggggttttyggtygtgtttygtygttygggtygygttyggggttgattygtattattttgtaaggaagtgaaygtttygtaygggaaggggaggygtttgygtyggtygtygygtagtttyggggaygttyggggttgtygtyggttyggggtygtagaygatygygggaygygygagtttttygtttttttttgttygtygtttttttygttatttttgttygagaggagttaaattyggtttttagagttyggggagggtggggatattyggtgtttttttygygttaggaggaagggggagggyggagaggatttttggttagtttgygtygagtagatttaaattaaaataaaaagattaaaggagtagyggtyggggyggtagyggtttttaggtygggatattyggggtggtgygttygggtttgygggggttgygtyggygtyggggaggyggggggagygggagygggygaygyggggaaggggggagttagggggagggygtyggtyggaggaggggyggattygttygttttagtygagtagagtatagtygagtygagyggttygggygggggtygatttyggttagygtyggygtagagagygggyggaggygtaggttatgttgyggttggtgtttatyggggttygggttatygtggatatgtygtaygttygttattttttggatttttagggtttygttattttttaagttatgtagaagttggtggtgattyggttgagttttaattttygygaggtygttattttgagtygggattgttyggtgtygtttttyggggayggagattttttygttyggaatyggtgagttyggygttttttaattttaygttttygttttygtttygggttygygtygygtygygtygttttygtagtttttagttygttygygtgtttatatttyggygygygttygggygtatagtttgagtttgygagatttygggaagttgaattygtygttatttggygaaggygaatgtgatgtgattgttgttggtgtgaatattygatgttatygaaygtttttataattgagggttattttaatttgggatttttttttttttttttagtttttttttttttttttttygtttttgaaataaaatygaygggatttagaaggggaggtttttygtygggtygttygygygtatttatagtttttgygttgatataatttttagggtggagygggagtagtttggaygtaaattgygaygtttaggtaaaygtgtttyggaggaaggaggttgggattyggttggttttttttgttttttttaggttggtagtygtttygtagtggyggagtttgtygttggatgtgtgggtgtgtatttygtyggtgttgtttgygtgttgttagtgtagtgtgattgttgtttgttttttgagtgttaaygatygtygygtggygygtgtttygggtagttgggttagggtyggggtgggggtatggttgtttttgtyggtaygttttgtagatatttaggtgatatygggttgttgygagattttttggtttttttatttttygygttttttatygtygtgttttygttttatttatttttagtaattggygaagtaatagggaggaaayggattttattttttatyggagttatgttygtttaggtttttgtttygtgggtttttggttgttygatttgattggtaaggygt

SEQ ID NO: 11342 - DNA, 652 bp, Artificial Sequence
  Description of Artificial Sequence: Synthetic polynucleotide
ygttttttyggtggagayggygaygtggtttataygygagtttttygtygaggatgaattattagttagttygagttgttatattttattttagtatagttatygygagagtttyggggtygygtyggygtgttttaygtaygygtagtttttygyggggtyggttagtggtgtygtygaggyggggggagtggtygtygygtyggtygagtgaggtagggttataygtaggygtattygygygtygatagttygtgtatygtgtggtagyggttgtgygygtttaggaaggatatttygttttygtaggtygtygggyggtagtagggttgygygygtattygttttygtygtaggygtygtygttggygtagtygtygtagttygaggtygtagaygygygyggtagtttygtaggygtttgygtagtagyggaatagtatygtttygtyggaygygtagtttaggtttagttygtttaygygtatttttagttygygtagttygtaaggtygygtttttaatygygtaygygygygtygtygtyggggtttygttygayggygyggatttgggggtygtttagtttagggygttagttygygtagttttatygtattyggggttttttgtaggagtgtayggtttgyga

SEQ ID NO: 11343 - DNA, 722 bp, Artificial Sequence
  Description of Artificial Sequence: Synthetic polynucleotide
ygtttttygtagyggtgtagygyggtygtatttygtattygttgtttggtgtygtggtygttttttygggtagtttttygggttyggygttggyggtagtggygagyggyggagattttttttyggggtagtyggtgttygaattgatygygtagttgttgygygttgagttttattttgyggyggtyggaygtttyggygtagggggyggygyggygggygyggtgttgggtatygataaygtgtgygagttggyggygyggttgttttttagtatygtggagtgggygygttaygygtttttttttttygagttgtyggtggtygattaggtggygttgttgygtttgagttggagygagtttttygtgttgaaygyggygtaggyggygttgtttttgtatayggygtygttattggtygtygtyggtttttaygtygygtttatggtygtygagygygtygtggtttttatggattaggtgygygttttttaggagtaggtggataagttgggtygtttgtaggtygattyggtygagtatggttgttttaaggttatygygttttttaygttyggtgagttaygtttygaagagggtygygggatggggggatttaagggaggttaggaggagggyggtttggatttagatttyggtttttatagygtttygttygttttttaggtttggggttttgtaygygtygtgagtgaaygt

SEQ ID NO: 11344 - DNA, 858 bp, Artificial Sequence
  Description of Artificial Sequence: Synthetic polynucleotide
ygttygatttaggtttygagtttttttttygattttttttagtttaaaggttgtattygttttaggtttttttagttyggttttttagtttttttttyggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygygttgtygggygaggtyggtttaygtggagtygggagtttgaggtttttgtaygygggagttgyggaygatggtggttagtgttattgtttaygaygttattgtggtgtgtgtgtgtgagagayggagattttagtgtgtgtygtgggtgttgtttgatyggatttaggayggtgagtaggggyggggtttatygtgtgattttggtttayggtgaygtgatygt

SEQ ID NO: 11345 - DNA, 598 bp, Artificial Sequence
  Description of Artificial Sequence: Synthetic polynucleotide
yggagatayggttataygagtaattttagygaygtttttttygygygtgttygtttyggtatttyggatatttttattttgatagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagygtttyggaggtttttgggagtgttygttygttygygtttagtgygtaggygttagaygtttagggtttgygagagygagttgagtggttttagggtttatttttggtaggagagagggtgggattygtyggttaggtaggtgygggggaggagttggggtyggtgyggggattygtyggaatttygg

SEQ ID NO: 11346 - DNA, 1281 bp, Artificial Sequence
  Description of Artificial Sequence: Synthetic polynucleotide
ygyggtgtyggygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygygtttygygatttgttyggttgttygygttgtyggyggttgttgtataagtyggtgaygttgttttgygggtttatagtttgtaagygttgygtggagttagggttygygyggtygtaggtgyggygygtgaaygtggtgttgagyggtttgttggagaagtgtttttyggtygagtgtyggttgygtaggttggtaggttaggygyggagtttgtagygttagtagtagtyggaggtygygttgtttaggtgygattaggttttggagttgggtgagtyggttgyggggygggttygttttttttatatttgttyggtttagtagyggggtggggagttggtyggtgggttygaggttttgggttttyga

SEQ ID NO: 11347 - DNA, 1788 bp, Artificial Sequence
  Description of Artificial Sequence: Synthetic polynucleotide
ygatgtagttyggagagagtatygttygygtagygaygygtatagatttttttttggagaygygtttttyggygygtgyggtygagttygygtgaaatgtatagatttttyggtgaggttttgtttaygtgtgattttgagtattgygaagttttttttttttattttygygtggttatttaaagttttgtttatatttygtaygtgtagatgttaattttatagaaatatatgatgtaaggatagaaatgggaaygattggaggttgattttttygtgattaygtttygttaaygyggtgygtttatgtatayggygagtaaaygtatatagtyggtaaatagttatttttattatgtttagtttatagttaygygtggggagaaggtagyggagagggyggyggtggtaggagaagtgggaagtygygygttygygtgggttgttttttgatagttyggygttgttttttttttttttygggaayggygtttattygggggtygtaggtttaygygtygggygygttygggggggtttygtagygtygagaaygggataatgaggaygyggtgataggttgggtttttgtygyggtagtggyggyggyggtagttggagttgttygtgtagtttttgtygyggttatttttattttygttttttyggtttttatttaygtttygagggtttttttgaattygaagatttttttgatgtttttagtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagagttttagttttttygggagttggaaayggagtttagtttgggggygtyggggttttttygttttyggygggagggggygtttttgygtggttyggaagygtygggygggygggggtgygyggyggtyggatgyggggygtygagggyggggygttttttygygttgtggtttgtggttygggggattygaggggtaaggygtggggtggggggggtgggggtyggttgttatggygaygggyggyggyggyggttgggatggaggyggaggygggygggagtttattygtattgtattaaatyggttttaygttagtttygggatagattygygaggagtaagtyggggagtttttgggygggtaygygtaggaygygttagtagttgtttygtggtttttttgygagtaaaattttygggggtgtttggtagtygygygggygttttggtgttgggttggagyggtyggygggtttggtygg

SEQ ID NO: 11348 - DNA, 626 bp, Artificial Sequence
  Description of Artificial Sequence: Synthetic polynucleotide
ygtgaggattttttyggtatygtttygygygggtttttgtttygtgtttaggyggaggyggggtggttattgtttttttttttygtttygygttttyggyggttttttygyggttttttgygtygygttttttttaggaggygttttgatttygtatttyggttttttatttttygatygttagttttagggtygtygyggygaygygygattttttttttttgaggggygygggtttyggaygygtygggttttgttaggtatttagtggagggtyggaggtyggygattagttygagtttagtygtttygggagttggygygagtgtygttaygattttttttgttttttgygttygygttgttyggtygtygggyggtygttttagtttttttatatagttttttaaaaatagttygtttygtatygttttgtaaggtagtagggagattygtagygtgttaattygygttygtygttagggttaagtttygttttaggttttgtttygggttttttattggtttttagtgattttatgagttttttgtttattttatatggttataygyggtttaatggaygtttttttygagattttayggttgygyggagaatygaaygg

SEQ ID NO: 11349 - DNA, 1037 bp, Artificial Sequence
  Description of Artificial Sequence: Synthetic polynucleotide
ygggtttgattttygygtttygttagtaatagttttttttgatttggtttaaggtttyggttttgtygtttttaaaatygttygtaaggtttagtygttygtygggttttttygttgttttttaagttttttttaattatttgttttagatygygttatttgtaatttgtttygggttggygttatattyggygtttyggygttttttataagtgttttygtttatgattagygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygygttggttgygggttttgggggttttttgtttttttygggtttygttttttygtatttttttggtttgattatgatttttgaaggagaatayggataattygygggtttgggtaggatyggygtggyggtggagaagagygygtgtttttgtttgtttttagtttagttygygaggatttygt

SEQ ID NO: 11350 - DNA, 977 bp, Artificial Sequence
  Description of Artificial Sequence: Synthetic polynucleotide
yggttttggygttaattygtyggtttttggttttttggttttgttatttttggyggggttgtgggtyggtttaagattataagagggtttyggygggaattttyggtggtgttygagggatttaggtaggtyggygatttttttttaatatattttttgaagttatygagaygttttgtatttgtygygtttttagagtttgtygtttttaggttttagttttgaggttgyggtgatatttattgggtatttygggttttgtaygtttygtaggtyggtygtaggtagtyggttttgttgttatttttttttttyggtygttggttggtttttttgttttggaggtatagagggatygggygttgaaaggtgtagttttgtttgtggagggatggatattyggagttgaagatagtataggagagaggggatttttatttattagtgaaggygtygttagggygtttgtttttatgttttttttagatttgtgatatygtygtgyggtttagattttygggggyggttgtatgttagggagggagtattttagggttttttgtttttaagggagagggatagtattttttygggtttttagtttttttgggtgtggygggagagttttgggygaggttgygtttatatttgtatttyggtyggttttttyggttgatttygttttggttgatttygygtatattttttttttagygttgtaaggatygtttgaattygttggttatttyggtgatgaattagtggttyggtgtgaagttgygggtgatygagggttgggaygaggayggttattatttagaggagtttttgtattatgagggtygygyggtggatattattatattagatygygatygtaataagtatggattgttggygygtttggtagtggaggtyggttttgattgggtgtattaygagttaaaggtttaygtgtattgtttygttaagttygg

SEQ ID NO: 11351 - DNA, 6206 bp, Artificial Sequence
  Description of Artificial Sequence: Synthetic polynucleotide
ygttaygttatatygagagaagyggagaygatatttttattyggtgggggygggggygaggtttttttagygyggattygggttyggggagtgtagggygtattttttttgtgggtttttaagygaaggtatagttygggggtyggggtggagggygygttttagtaggtygggygtaygggtatttgtaggaggattatttgtttgttttyggatgggtggtatttgttgatgtgtygygtaaggtygggygagttgtagaaggtggtygggtagtatttgtaggggaatatttgggyggygtgtagtaggygtaggtggygtttttgagygtttttgttggygaaygatttttygtatattgggtataggtggtattyggyggaygtatttaggtttagtaygtyggttttttygtygtygtyggtygttttttggggygttttttygtygggttyggggtataaggttagtaggttttyggtygggggygttagyggygygtttttggtttgtagygtttggtggtgygttagtaggtgtttgygtaggtaggtttggyggyggaattttttggygtagtgatggtattygtagagttygttttyggagttygattyggataygtygtyggggttyggygtgtttyggtygttgtygtygtygggtgtttttygygttttagttttggttgttgtttttggtttyggygygygggyggyggygggygygggtygyggtttgtgttagyggyggtgygaggttaggttggtygggtagttgaagattttggygtattygggatagyggtattttataygtaygatgygygagtatttgtgttgygttagygygaaygggtyggygtatttttttttgtatagttggtagatgaattygtttagyggtygygtygygtttttygygyggtttygyggygtttttatygggttttttttgattttgagttttagtaygggygaygtggttatttygttttygaagtgtagtttgyggatggttttgggttttttggygttyggggttttgattgttttggygggyggtttygyggyggtagggggygggggtygttttttygggggtygtagggyggyggtagggggtagtggggggtyggggttygggtygygggtygtttyggygttagtygagaaygtygtgtttattttgagttyggygggygygaagagtagygggtygtygtygtaggtgtygttttygttagtttygttygygtygtygtygtygtttttttygagtagygyggygggygtggggaaggattyggtygagatyggygagtttaggttgaagttgygttygaagtatttgtgtttttygtgttygyggtttaygggtygygtgggattgtagagyggygyggggtgygtagtttyggggttgtygaagtgygyggttygygggttttgygggggtggttgyggtttaggygygtaggtaagygyggyggygagygttgtatgggygygtttygygggyggyggyggyggtagyggttyggggatygggttyggygtygggggttyggygygggygttttygtagttgggygagagtagtagtgygyggtygtygttttygtygtygyggattyggtaggaaaygggygtggattttttgttgygttttattaggaagtygyggggtatgttggygyggttygagggtayggtattggttyggtttttttttygygttyggtttyggyggtttttagtgttttyggtttattgttygggygyggyggttgygggattygygtggygtyggygayggttyggtttagttttgygttttgtaygygygtttttgttttygggttyggtagtygtttttttttaayggggggagggggttattgttttygtttttygttttttttggagttaattagygygttygtagttttttagtttggtagggtgggagggygatggggyggttaaaagggggtygggattygggggtygttyggtaggtgyggtagatgtatttgagggygyggggttttygygygygtttttggtygtttygttyggygtygtygtttygttyggtttaggtataygttyggtttygtttttttttayggtttgttgtttttttatggggaggygtaygtgtttgggttttgtgtttttttttyggggggygyggagtygttaaatgggttygtttattagygygataatgtaygtttttttttygygyggggattattygygggtygttagtaaaatagtaataaaggagaagaatggttttaaatatgttaggagggtttaattygygagtyggagtygagggggaagttgtgygygttgattgggtgggggygggggygygtyggggyggtgygggggagatygttgyggaggygtagtggtttygygtggtgtttgggaaataaataagaattygagagagtagtagggttyggayggttttygttyggattttggayggatgggtygttggatttaagaggttaagtaaaagggtttttyggggttttaagtgtggatagggggttyggttttttggtagtggtygagggygatgtttgtgttygtagttttygygygtttayggggttagagaaggtttttttygagtttgagaaggaattggtayggtttttttagtttttygaaagygygggattggagygygggygggttgggttgggtttttagaggaaygtgaatttttgaatttttgggtttttggaggtttgggaatggtatttttggyggggttygatttaggtygttyggagttttygygtggtttaaggttyggttaattygggtygagttggtygaagttygaaaygygyggtyggtttygtgygttttagtgaagttggttttttttttttygygyggttttatgtatttttatttygagygggtattttgtttgtyggttgatattagatgttaaattaagggttttaattaaggygttgygaaataaaggggttgtttgtttgggygtagtttttayggagtygtgttttttttatttttgtgaaggaaattaattttttgttattgagtttyggtygyggttaatttggaygtaaaagagaygygtgttggayggggggagggggggtaatttgtattttgaggtaggttgaggttttygagaggataagtygttttttttgtgttattaggaagagataatagygaagatttttttygtttttatttttatttttatttttgttgtygtttygtttggatttagattgggtygtttgtttttattttttgtttagtttagtttygaggaaatataaaaggtagaattttygggggatagggtagagaattttaygagtgygtagtggttttgatygtttaatattggggaataaatagttaagttatataaaatgttatatgttgtgaggaaaatgttattttattgaaagagaaggaaatatttttttgtaaagttttgtatattagatagattttgttgagttttatttaygtttaattttattgaaggtatttaattgttttggattttttttttgaaaatattttggygtagaaattaaatatgtaaaaatagagtttatatgagttataagttgtgatggggatagttgttaggtttaattaattaaggggttaattaggttggttaattaagggaaagatatttgataattttatgtttgtaatattttaatttatatattgaaaagggaagaatgtatatagtgaaatatattttgaaaagttttattttagttttaaaaatgttgtggtgagtgttagtttttttaaaagttagaaattttaaaatgagtttatttaaaatttataaatatatttttatttaaaagtaattgatgttatttttttgtttttttgagttttgattaatagtgttgatgaaattagaagtgggaaaaggatttygagatagttttggttaattttattttttaattaygaattttatttggattgtagaatagtatagggygggggttyggtttgttttattyggttttgtatatgtaatattttttttatttaatagataatagagagttagttattttgtgaattttttaaaaataataatatttataattgtaaataagtygtggggatgggaaatyggtatttttattaataaaaaaaataaaataatttttgygtgagtgaatttaaatagggttttgaatttagttaagggaatttattaaaygttattgagatattgagatttaatgaattygtttttttttttttatttgtggtttttagttttgttagygtaaatgaaatttgtttttagaygggtatagttaaaataaatggaaatttgaaaggtattagtattggaaattaattttattattyggggttggaaggagttaggttgygtaygygygtaygtatatattagygatttttaagtaggtgtagtttagttygggtygtggatygtagtygttttttgygtgatttttttagaatttgtgtattygtatgtatggggatatygggtygagatatttgttttygtttgggaagagtaaagygttattatagtgygttttygaygtyggttttggygtaygygattyggagaatgggtygygtgaagttaagttgggggaaatagygyggatttgtttttttttaggggggtttygygaaagttagtgaatataaggatttaaggtagagtatttaaggggtttttttyggttttaggtgatttttttttttttttyggggttttggttagygttttggaaaaatttygggtttttttatttttttttgyggatttygyggtgggtttttttttygaygattgyggagttygaggttttaggttttttaattttttttattttggtgtgyggggatgtygtyggggagygygtyggggtttattttgatttttattayggttggaaattaaagttaaggtaatagggagtttgtagaaagygygaagtttggaaataagagtagaagyggggaatttttgyggaggagttggttttttggggtgtttaggagaataggaggttttggttttaygggaggagtygggygggttygtatttttatttygtagagggtatygygtttggagaygtyggygttgggggtgaggtgttagygttttttattattattttgttgtagattttttttttggttttatagaagtttttattttyggtttttagtttttygagttataatyggtaggaatygtgygttatygttgtagtgttygtygttyggagggattagygtttttttgygtygggtgygttygattygagtyggtgagaggttttgtatttgtaggaatgaggggttgttgtgttagttttaggggtaygygagagataygygtagttygtttggtygttatttygttyggttyggttttaggtatttttygggtttttygttygygggtygttgtttttgttyggygtattagtataaagttgttagggatttttygtttagataattttatataaaaggagagtgtatgaaagagagygaataagggaygattygygaggttgygtygtgygttttygyggggagggatygygtttaagtattttttttttttygagttttaagtgttttttggtaatttgttgygygtttattattyggtygggggtygayggygtggttggttattttttttattttttygagagtatygtyggggttattgtaygttttttgaagtgtttttagggttgtttgtttttgttttagtgggatygtygggttagggagggaggagagygggtaggaaggttygggygggyggygggaagggygaygtyggygaaagttggtagaggygaagtttagaaggtgagaaagttataattaaagaattaggttagggagagttaggayggtaygggatttatygggatgatattgattttggggygtaagaggtgttttttatttgtgaggtgttggyggtygttagttygtgygtttyggttttaaayggaattgataaaatttagygaaattgattagaaaggttgyggygatttygattttttttttttttttttattttatttatatttgtatttygtttygtttgtygtaggaggayga

SEQ ID NO: 11352 - DNA, 574 bp, Artificial Sequence
  Description of Artificial Sequence: Synthetic polynucleotide
ygttagygttaaygaatgtggggatagttygtttggygttygyggtygtatttttatygggtagtttygtatttttttttygggtttttaagtygttygtttyggttgygggagatttyggygaattatattygagaggggggygygtggggyggagttttttttttattgttttttygttattagtygtttttgtygtygagttygtagtygttagygygtttygagtttttttaggttagaggttttygtaggygatggyggataagagggyggggattttagaagtygyggygygttygtygttyggttttgttygggagggggaygygygtayggttttygyggttygggttygagaagttggggggygygggtttttttatttygtagygggtttygggatygttttttttttttttgggygyggggaagyggtttttayggygattatttygagtttggaaaatggtygggttygggaygaagttttagaaatttgtggtgtagaggggttagggattygggtaggagttagygagaaggtygaggaygygaataaggaggagggygt

SEQ ID NO: 11353 - DNA, 3438 bp, Artificial Sequence
  Description of Artificial Sequence: Synthetic polynucleotide
ygtgtttgtttygttttggtygtttgaggtyggagttatatatagtttgtatagattygagatattyggtttygagtgatttggaaaygagtgtgtttttattgygtttaaataagaygaggatatttataaggtgygagtttttaatttttagttattggtaggggttgygtagyggtatygtttaggttttttttttaggyggtygatttatttttgyggagagtaygtttttygaagagggttgtagaygygtttttttagtatttaatttgttattttataagattgagttaagttttagttaaaatatatttattttattaaaaataggyggtttaatattaygtygtattttagttttttygagggygtaagagaatagagagtttttagattaattggaggtaaatattttattttttaatatttaaaaataatttaggygygtttgtatyggtgtggtttaygygatttttaygygygaggttagtygggttggtttagygtagatagyggtygggatttatttatttagtgygygttttttttgtttttygttgygygygtttaaagttagaaagaagaaggtgaygygggaggygggtygggttttygggtttagygaattygygatttattyggtttyggygtttgagtygaggttttagaaagaattygttaattttagttattttggatttgggtagggagggtgygyggtttttaagtttagtttggatgtttagtgyggtgtgtttyggttttttygtttgtttttyggggaggttttttattyggtggttttgggtygttttattgtggygtttttatttttggttatyggttttttttygtttaggatttttyggtttagggagtagtygaygggtattttygaaygttggggtayggaattttaayggggygattagagyggagttygyggttygaggttygyggttgagtaygaagaygggattygaggatttgtatatygttygaggggaatttgttttgggttttggtgtatatatagtatgygttttgggttggtttgggttgggttaggtaggggagatttggttgggtaygaggygtygtttaagtttttyggtygtgggtygggyggtygyggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygttgygttttygtttttygtttttttagttttttttygtttttttttttygygtttggttyggygygtttyggtyggtygtaaagtttttygggyggtagyggyggttgygtttygttttagygatggtygyggagttgagtatggggttagagttgtttattagttygttggttatggagtatgttaaygatttygatttgtttaagttygaygtgaagaaggagttattggggygygyggagygttygggtaggttttgtataygtttgtagttagtyggttyggtgttttttatatygtttagtatttygtgtagtttygtgttttygtygtttagttttagttygatygaatagaagatatatttygaggatttgtattggatggygagtaattattagtagatgaatttygaggygtttaatttgaygttygaggaygyggtggaagygtttatyggttygtatttagtgttatagtygttgtaaagtttygatagttttygyggygtttattattattattattattattatttttattygtattatgygtattygggygtyggygtggtttaygaygagttgggttygtaygtttattygtattattattattattattaagygtygtygtygtygtttagygtygttagttyggygtaatagttgtttattagttatttygggttygggtygtaygygayggtttyggygayggyggygggyggtaayggtagygtggaggatygttttttygaygattagttygtgtttatgttygtgygygagttgaatygttatttgyggggttttattaaggaygaggtgattygtttgaagtagaagyggyggattttgaagaatyggggttaygtttagttttgtaggtataaaygygtttagtagaagtattatttggagaatgagaagaygtagtttatttagtaggtggagtagtttaagtaggaggtgtttyggttggttygygagagagaygtttataaggttaagtgygagaaattygttaatttyggttttagggaggygggttttattagyga

SEQ ID NO: 11354 - DNA, 4088 bp, Artificial Sequence
  Description of Artificial Sequence: Synthetic polynucleotide
yggttyggtttggttygggataygtttgtttygygtatatatagttagtyggttttgttygaaaygtattaagtygygtttagyggtaatygttttttttttttttttygtygtttttttttygatttyggygttaygatttttttgygtttttttttttttattgtattatttttatygtttygatttttttygaggggttgatgttattagtttttttatttttttyggttattttttttygttaaagtttttttttggygaggtttttttygttattayggygttttttagygttattttttttttttttygttttttttttttttttttttttttttttaataaattttatattttayggaggygggtttttttttttttattygttattyggttttttgttttygaaattttttttttgtygtagttttyggagttttatgggttttttttttttttttttaataygtatttaaatttttggygtygtgtaggtttygyggaaaaagagagaaagagagaaagagggggagagygagagygagagtaagagagagatattgagygggtaggtygggggagggggattygygttygygtygttayggtttttygtttygtttttgagttttygttyggtygaattygygtttttgggtttttttttyggtttygttttttatagatagagttygygaaygggyggggggttygggagygygygttyggggyggggggygggttyggygygygyggtttgyggggygtttttygagggttttygggtyggggtyggygtttttygttygtttttatttagtagtagtaggyggtgygtggttyggtagatttgtttgtttttttgtagttgtttttygatttttttgttggttttaygttgygtttttttttygttgygttggttttyggttttattgttttygaggtagtttatggyggyggyggyggyggyggggygyggtygggttgyggyggyggygggygygggyggttttaygtgggtygggagggtyggggtagygtygggygggygggtygggygygggttyggtttttyggtaaggagygygyggggyggattgygggtygygggtygyggggygygyggaygggygggaaggggagggtgtyggtyggatygaggggygygygtagtttttygtttttygagtygaggtygagggggttgatggtygtygtygggtygaggyggattagagtaggagttgygggagttgttgtygtygttgtygtygtygtygtttttattgtttyggtygggttttygtygtygtttygagttaaaagygtygyggygggyggggggaggyggggggaggaggaggyggyggyggygaggggggtggaaggaggaggaggaggaggagggtygaggagyggtygyggyggyggyggyggttgggagggygggagtyggyggagggaggyggtttttygggagttyggggagggggttttttygttygygttyggtyggggaygggaygggtyggggagaygttttttatttttygggttygggtagtagttyggttgagtygaggggggagagggggygttttygygttagtgaygatttttygtaygaygttaaygttttatttttyggatygygtygttyggygttttygaggttttttttttttttygygggygtygtygaggggttggggtgggyggaaggggagggagygygygttyggatttaggaaaattttygaaagagygagagatatagagagttagagagtaggagtgtggaaaaagygaggygagtaygaattaaaggatagagtaatygaaaaggaaaatgtgtttatatatatataygaataygaataaaaatttatattatatagygatggtggtgtttggtggyggtggyggggtggggggtttgattagatgagtygtttttygygttttyggygtygggygttatggttygagtygaaggygtttttggtttyggagygttygyggtttttgygtttggygyggtygtttaagtaggagaagaaggygtagtttaggaatattyggaagtagtaggtygtttygaataygaagtygtagtygyggttttgtttygtgygtttttgtagtaggaagttgagtatttaygaggggttgygtatygagaagattaggaatattaygaggggtaggtgggygtttagygygttagttttgagyggttygggtygttataygatgtttttaaygygyggygtygygtagtaggygtygttttygtygttygagttygtgttttagttagtttaggttttattygtgttttyggyggyggygtttttttyggygttttygayggygtttttttyggygtttttgtygtygtyggyggyggtygyggyggyggyggtttyggggtatygggtttttttttgggtttttggtattttttttttttttttttttagtattttttttattttttttttttttttttttttttttttttttttttttygtttttgttttagtagttttttttygagttttttgygttttttgtttgttaggaatttttyggggagygtttttygygtygggtttttggggtttttygygagtttttyggggttttygttttttygyggygygagyggttttttyggttyggttaaygtygtagtygtygtygtagtttyggtagttatttyggtagtygtygyggtygtttttttttygtttttygtygttygggttttgagttttatggttatttttagtatggtggttyggttatttyggggagttyggttygygtttggttygggttttttgtttgttttyggtttygggttgttyggttttygtgygtttygtgtyggggggtttggttgyggttttygtygygttgtttyggggtygyggagygyggttgttygggtttygggttgttgggttggttgtttaagagttagygttaaaaaggatgagtaaaygaaaaagggataagaataaattaaaaagtatttaataatagygagaaattaaaaagtattaagaaatgttaatttaaaaagaaaagtgtaaaggygyggatggtaggagtttgtttatttttaggygttttttggtttggtttttgggtaygttaatggagaagagaaaagagagagaattggggggtgttyggaggygtttyggggtaaggtagyggygttygggygtttttgttttgtttyggattyggyggtttttgtttgygtygggygattygtattttygygggaggtttyggygtttttygatttatatgtgagtgaggtgtatttataygtaaggtagygtttgtyggtygttygtygtygtttygygtygggataggggttygttttagtygtygygtygtagttyggagttagagagtaggggagygtygygtyggttagttatttgaygtagttygtttygyggtgtygaygygattgagtgttttygtyggggagtagagtttttaatyggtttygatgaygttttagtttttttagaggatygatttatagtagyggtttttataaatygaaggggaagygygaaaaatyggtttatyggggaygtatttaaatgggtygtygygtattttgggggtgtaggtyggtgtygggatygygygggygtgggtygggggygygggggtygygatggyggggggygygggygygtttaaggyggtgggygtttaatttygttttttagatttgttttttaattttyggtgagtggtgtagttttgggyggygtgtaaagtgtgygayggyggygtttatttttgttgtgygtttttttatttttagttatttatttygtttttttagyggygygygttygtygaggtaggtgttagagagtygaattygaattatttgygaygttyggayggagtttygtattttyggaygagaaaagtgygatgggagtgtaaagttttttttgttygaagtagtaggygygtyggtgttaygggagtygaggagyggtggtygtggttgtggagtyggtgttygaggygt

SEQ ID NO: 11355 - DNA, 522 bp, Artificial Sequence
  Description of Artificial Sequence: Synthetic polynucleotide
ygatatagttttyggygygtygggtattgaggttttggagtatagygtggggggtttggtatagataygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtygg

SEQ ID NO: 11356 - DNA, 2260 bp, Artificial Sequence
  Description of Artificial Sequence: Synthetic polynucleotide
yggtattygggtygaagygtttggttygygttttygygygggtttttttggaatygtttygggataygyggttttttygttgttggattttttttygagttttagtttgttaggtagggattttttgggygggyggyggggaagygtygagtyggyggtygtttatatttttttttaygtagtataaaggatattygtyggtaaatttttttygtttttgattygggtygagtygggaatttagygttagttttgtttttggyggggttgaggttttttttatattttaggttatttggtaaaygttttgaggttgttattttttttgggtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggatygtygagagttyggtagattttttttaaggttttgattttaatatttttagtgttttgttaattatattttttgttttttttttttattaaggttatygttaagatattttttttttttttttttttygtygttygttattttttttgttttttttttggttttttttttagttttttgggtttttttttygygttgttttttagttttagttgtttttttyggtttatatttyggtagttttttttttttttygttttygggtattttttttttttggtyggtttttgaaatttagtaggttyggtttyggttattgtttttttttgtttgtttttatttggtttgtttttttaattatygtttttttatatttttttttttttttttttggtaagggggayggggggaaayggggtattatattttygtttttygatttygttattttttttagtttygtgagtygygttttttygttttttttaggttygygattttattttgaggttttttagatttygtagggttttttaygttattaagtttgtttygattttttttygttgttttttatattttttgtygyggygyggtyggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttygggtyggtgtttttgtygygggaaggaggattyggaygtttaatttagyggygaagtygttttttattggaggaggtttttygaaaaygt

SEQ ID NO: 11357 - DNA, 1502 bp, Artificial Sequence
  Description of Artificial Sequence: Synthetic polynucleotide
ygayggtgagygtggagtagttygyggtttygttgttttttttattttyggatttttagtttttttagagtggaggggtaagtatatagtaagtatttgatattygttygatttttgagttttttatttgtaggagttagggggtttgtttttygtaygttttttgttggagggaggaaygagggaaggagaaaatttaygttgaggtygttggtygattattttttttatttttyggataatattgatgggttttattaaggaaagtygaattttygtatgttygaggagtgtyggaggtggttgtgygtttagttttttttggtaaagggttygaagtattygtttatttaaaggyggtygagagttatattatttgtttgtatgaygggagatatygaaaygttttttttgaaygygatgataaatatttttttttatttagtagygaygtgtaygtgatagtttttgggttttygtaattaygtggaaatttggaataggtttgyggttgtatatygttyggaygtyggggtttttgygtttttygttttttttgatygyggttgggtagtygagtygtaggtagttgggggttttygaaygtygtttttgtatygygtygtttttgtttygggtttyggtagttttygggttttygtattgttygtygygttttgtttatagggaagygtttttttaggyggyggyggttttggtgyggatttttyggtygtagttatgtgggattygygggtagttaggtgygtagyggygygggaagtattggggtatttttggtttttygggttygttattttttttggygggaggyggtygygygyggggattggygattttgaggtagyggtygaaygggttygttyggttatttttgtggggtttatagttatttaggtgtagattygagttagttgygyggggtyggtygygggggayggtttyggttttttyggttyggagggattagggtaygygttgygataggattgyggyggygygyggtttgtttagtttttatttyggtatygaagtygtagttttygggtttattttygtatttttaggggttttygggggttgtygataggtttttgattagygagygygttttyggggtaagtatttttggygggtagaaatttgggagyggagtatagyggtgtaagggaatygtgttaggygggaagggyggaatttgyggggaatttggagygygttggttttttttyggtagtaggaggtttttttttttgttygttygattgagggttgttgggttggtttaaattggattgtayggtttattagtttgggtttatygagtttagggggaaggtagtagtagggatttaaggttgggaagyggagtttttagaagtttttgtttttgtttyggagygttttygaatyggagttyggagtttgttgtttgggaggygygttgygtttttttttaattttttgttttygtttygygg

SEQ ID NO: 11358 - DNA, 510 bp, Artificial Sequence
  Description of Artificial Sequence: Synthetic polynucleotide
ygttttttgtygggagttattygttagtttttttttttagttyggttgygtagygtttttaatttaatttttggatttattttygttttagtttttttygtgtttagygttttttgtaaatgattttttyggtygggtgtttygttttttttttyggtttttttygygtggtttgtttttygttygtttgygttygttyggtttttttgtttttgygtttttatttgatygtaaaggyggttagggtagttttygygyggtttgatagttayggtttttagtttgtttttggaygtgggaaattygggtttatagygtttttaygtatattgyggtatagattggygttttttayggygtttttattggaaagygtttttgtggttttggggagagggyggttttattygttatttttttyggagttgttttygtttatttttatgggaggaaatygtagggygtgtgagttttygatttttygtttttattttttttaggatyggtygt

SEQ ID NO: 11359 - DNA, 940 bp, Artificial Sequence
  Description of Artificial Sequence: Synthetic polynucleotide
ygggtaattgttygggttttgtttatttttttygygggtygtatttgttaaggtygtatygttagygttttttgtygttttttttgtatagagattygygtttattttygtattygtattygtattygtatttgtttttatttygygttygttttgygtygaggtygygtagtttgygggtagtggygggggtaygaggatgygaatttaggyggggtygggagttgggygygttttttagaattttygttayggttaggtttgagttttatttatttaygtygtattttttttttttygtgggggtttatatggtygtgtygggygyggtttygygggygyggygatygggygataaygyggyggggayggtygygggttyggttgtggygtatygygagtygaggyggggayggttaggyggygyggggtagtgggyggygtattttttataggtygttygggatgtygtygttattttygttaygtttggatygygaggtttygygggtggtttagtagtttttggyggygygggygaaggttygttatttgttygtygtygttgttttygtgtygtygtttgtttttttatagtttygtygttyggttttyggygtygtygyggttyggttygttttagygggttygtaggaygttygygtatgygttattttttgtygygtaggggttygygttgttygggttygygtygtttygagttygygygygaatttaygygtygttgttgygygttagyggagggaaattygygagaagttattggattgttyggtttyggatyggtttttagaatygttggttyggggtttttagttgtagtaaatttyggagggggygaagtyggttaggtgggygattttttttattyggattttttattygttttygtttttagtgttttttgtttgygtttyga

SEQ ID NO: 11360 - DNA, 2718 bp, Artificial Sequence
  Description of Artificial Sequence: Synthetic polynucleotide
ygttygggtygttttttttgtttagtttygagygyggagttgtttaggatttttagaygggtgygagttattgtttgaagttttttttttttygtyggaagaggatgtgtttaaaggatygtyggaaattttggttgaagatygtgtagatgatygggttgagygagttgttgtagtagtygatttagaagaagaatttgaagagygggtygggtatttggtaggtttygyggtagatgtygtataggttgtagttgaagaagaaggggaattagtagagtaygaataygtttatgattatagttagtataaaggtgaagygtttttygygygtttgggttattttgyggyggtataygttgttgygygttyggygtyggygygataggaagaattygayggagygygagttggygygygataggyggttatygggtttyggggatttggaggyggttagygttttygatttagtygttttyggtttygttttttgttygttygtatygttygygttttttttygygttygttygtygtygttygttttgtygtaaygygtttyggygtygtygtttttyggtygttgygttgttttygttyggttttaygtyggygggygggggygygtagtgttygttttygtttgygtttgtygtygygtttagttygttttyggtagtyggggaygtatygtyggggtttaygggggygygtttttygttgagygtgygygtgygtagtttggttattyggtagatgygygygtagattaggtttatgatgaggtagggygygaagaaggagtygatgtaggaggataggatgtattaggtttygtygttgaggtygtattgygggtaggyggygtygtygggttggyggtagagygagattagyggygggaaggagatgayggtygagatgagttatayggttaygatggtggttttgaygyggygtggtgtgygttttaggttgtattygayggtttgygttatygattagtagyggtttaggttgatggtatatagatgtaygatygaygaggtgtaaaatagtatatygagygttaggtataygtygtattatatttgttygaagtattagtaggttatgagttygttggttaaygagaagggtatgattagygtggttattaggatgtyggtygaggttagygatattaggaagaggttttgtggygygygtagygttyggttggttagtayggygattattattagtaygttgtttattayggtgaagaygatgaggaagtttattayggtagttagttttgttatygygttygtygagtattggtygygyggyggtttttaggaagttttygaggtattggtaatttygtygttgtttttttygttygygtygttygtattggggttygtygttgtygttatygttagygtygtygttagygtyggggaygttatggttttttygygagttaygtygttttttttggagtyggggygtagtygyggtagttygggygttttttagtyggggtyggygttygtatygtygtttgttgttygggygygttygtyggggatygyggygtttagtagtyggttttyggtygtggtggtttygygggyggygygtyggagagygtggttgtygggtttttygtagttgtygagygtgtaagtgtagagtaggaggygttyggagygagyggygaygyggttgyggggggaggggggtaggtttyggggttttygygyggtttygttttyggttyggtttayggggagygtttyggygtygagtttayggygaygyggygttygagygggygtgtttgagyggtttygyggtttyggagtttagtyggggygtaggygataggyggyggyggttygggygtttygttttttattyggtyggttagggttyggygygtyggggygtyggtygtygttttttygggttttygygttygygygtttttttygtttttaattttattttttygggyggggygtyggygtygtygygagtttttyggttgttttygggygygggygtttttygyggtttaygtttggtygtgyggtygtygtttygttygtyggagttgygtygtygtygtygtygtygttttgygttgggygygagtgyggtygtttgygatyggtttttaatttgggtygagttgygtagyggggygggygygyggggyggggygggtygygggttttggggagttggtygggaatyggagttygyggtygtttggtygaatttgttygygyggygtyggggaggagttyggggyggyggygyggggygygygttyggygagggygttttttttagggtygtttgtagtttgygggayggggtygagyggyggtyggtttgggtggtgagttttagaagttgttttttttaagattggagtttttttygtttttttyggygtaggtatgggygtaggygggggygygtataygygygygygtagtaygggyggttyggggtttatggtttgatggtagagtaatttttygtagtttgggggaggaygygaygttatttgygtgygtataggttttgtygagtttagggttyggattagattttggatyggygtttttygttagagttattttygtatttatttyggttttagttttttyggtttattttttagygttgttggagtatgaattataattaayggygg

SEQ ID NO: 11361 - DNA, 2661 bp, Artificial Sequence
  Description of Artificial Sequence: Synthetic polynucleotide
ygygggtaaagygtgtttttyggtgggttataagtagygttyggtttttttttttttygttaagttgtttgatttttttttttaggygygygygtatatattatatttatatattttaaaattaagattygttttataggatttgggaaaagaaaaagaaaaaaaagtttttaattattatttttttttygtygatttttttttatttttygttttttttttagygggtagttaaggagagttagaggygggggaggggagagggaggagaagygaygtaagtgggtagttttttagygtyggygaggygygggaggaggagaagtagtggggaggygtagtygtttatttgyggggtagggygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattygggygtygyggtagttgtttyggttgtyggtyggyggtttygygttygttygtttygttttygttygttgttttgttgtaygaatttttttaatttttttttttttttttatttttgagttatttttttgttttttttgttgttgygygggtgtttttatagyggagyggagattatagagtygtygggatgttttaatttttyggaggaggtggyggyggygggggggattyggaattttgygttayggaygagatgattttttttaaggaygagggygatttttagaaggaaaagattttygtygagattagttatttygaagaggaaggygatttagttgatattaagttttttttggtgaaygagtttgaaattatttyggttagtaayggataygaggtgagygggtygttgttttagtttygagaggygtggygggtttttgggaaatttagagagggaggaagggaaygaaggygttyggtygttyggttgagggtttygagtagatttttygtttgttttggggtgtgtgygtagttgggttttyggttygtagtgtgtgtgtgtgtgtgtgtgtgtgtgtgtgtgtgtgtgtgtgtaggatgggaggtagaggggtagggtaatttattttaaatggattagtttagggggttyggtggttgaayggttggttygygggtaggaatttataatgtttygttttyggtttttttgttgggttgaggggtgtygtgttttaaagygagtagggttgaataaygttattgataaattttttygtgggayggaaaataaagtgtataygttattttttggtagatgtttttgtaaaagtgygttaaattattaaaggtttaggtggagaygagtagagttataggygggaggaaggggaggygggygtgggttggggtaggyggggtygtttttattatyggtgagtygggtygyggggagtaggtyggtygatggggygygtattygggttgygggggyggtgyggggtttagtttttgyggttttagygtttgggttagtagttgggagttgtgggtgygtygagtygatttatygtaagggtatattttggttgtatygtttttaattttagttttttttaatygttattatttggaaataaatttataatttttatttggggtttgggatyggattaggttttaaatttaygtagaagaaaggyggagaagtagyggaagtygggtattagttttgtagggtggaaggygttttatygggttttttggttygttgygggygatagagttggtaatttgagtagagtaaatagagataygtgggtgttggttagagaaagygyggagtagggtygygt

SEQ ID NO: 11362 - DNA, 801 bp, Artificial Sequence
  Description of Artificial Sequence: Synthetic polynucleotide
yggttattaagyggttttttygtgagtttygtttaatgtttgtgygtttaaattagtagygttygaggaaygygttaattgggagaagtgaattgagggggttyggyggtygttgaggaggggagygygygggaggaggggygaggagttyggaggygggygyggttggtagtttagagggttygggyggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygygattttggttttttygtaagtttttyggattygggygttttyggtttttttttatttatttttttgtygggtaggttygygatttttygtttttygggtygtttttygtygtattyggttttggtatatttttattatttagttygggttygttttygttttgggtttattttagttttttagygtygtttgttgayggagygygggagttttaaggggtyggggttattyggtyggygtgggtggtgttaggttygggttatatttyggtatyggattygagttttttagtttttygagtaggattyggaggaatagaaygttaatttttttygt

SEQ ID NO: 11363 - DNA, 311 bp, Artificial Sequence
  Description of Artificial Sequence: Synthetic polynucleotide
yggttaayggtattayggaagtattagttggtatagaggttyggtgtaattatygttttgtatygtaaaaygggtttaggaagtttttaggagatattagyggtgttagaatygagaaagtgaygatatagataatttatggatttygygtaygggaaaygtttygttgggygttaagaayggtgtagtaattgaaaaatygtttagtgggygttattggtaaaagygttgttgtaaaatygttagtttygtattagaagtagagtygttagatagaattygggatttgaaattatygaagyggagatyga

SEQ ID NO: 11364 - DNA, 1048 bp, Artificial Sequence
  Description of Artificial Sequence: Synthetic polynucleotide
ygttttygtaaatttttygggttttaygttttgyggttattaygtttgatagagaaataattagtattagyggttgattyggttgttygggttttygtgtaggygggygggagyggataggttttggtaygtatgygttyggggygggattgygttttaggtttgygygttgtygttagattagygggggggyggggyggyggyggataygygttttaggyggtagtygygygagagggattttgtgtttygttgatttttttyggggygttttttttygtgtygttttttttttttttygtygygtttttgygaggygttttttattyggtgggatygattyggggggatggagggggtaygtttttataatttttttgggatttygaagagaygttygygtgygatttgagaygtygttttygtygagggtttatgggygygtttttataggygggtagtggaygtgagggyggygagyggyggggtygyggygtttaggagggtygygttygggttyggtttygygtaggtygygygygygygttttygtygtygttygggtygygttygtttygtttttaggygtyggtttyggagttyggttygygagtagyggyggttgtyggagggaygatgagttgygyggggygggygggttttgttyggttygtygygttygttttgttgatttgtagtttgtggtyggtaygggtagataaygygagttaggagtattatayggygtttattaaygtgayggtgtaggagttyggtygyggygtttygtttaygtttygtatygatygygggygttaygggtttgatttttttaaggtygaggttygyggttaggtgttggygtygttgtttttttayggaggtgagtgtyggttygggggyggygggyggtggtygttgtatttygygtaggyggygggattagggttttyggtttyggttttggttttggttttttygygttgttyggtygatagttttagttagggtygaggttttygtygtggatagttyggtttgttttygt

SEQ ID NO: 11365 - DNA, 301 bp, Artificial Sequence
  Description of Artificial Sequence: Synthetic polynucleotide
ygggaagtagtaggygtayggtygtttggatttttttggaggtgatggtygagygtttgttgtaatgygttaggygggaagtttygtyggygatgygttygaagatgtygttgataaaggaatttatgatttttatggttttagaggagatgtyggtgtyggggtggatttgttttagtattttgtataygtatayggagtagttttttttgyggttgygtttgygttttttgtygttttttttttgygttttggttayggtttttttggagttttttttyggggygggagyggatttygt

SEQ ID NO: 11366 - DNA, 1395 bp, Artificial Sequence
  Description of Artificial Sequence: Synthetic polynucleotide
yggttttgtgaggtttaygygggagygyggaggtttttgggttttagggygtyggtagatggtttgtagygtatygttyggttttygygttggttaygttygttagygttatttttttttttygttttttatttttaaaaattyggyggtygagtagtttygtatttyggagggttttyggtgtaaaattgagtgggaaagagaaaggggyggagagygaygagagagggaaggtggggaagaagagttyggtygttttyggtttttttyggygagttttgagtttttagggtttattygtttttttaagtygaattatagaaattttttattgttatgttaatgaygagaggggttgtggggagagggtttygaagatttttttggaagaagggaagtttttttttttgttttygttttttttaygtttattygagttttttttagttagttttttgygtttttttttttttatttygagtttgaagagtyggtggtttagtttygttttttattayggttttatgygttttttatagttttayggttttttagtttagttttagaatagaggaggtggtttgggaattyggggygyggtgttagtyggatttttygtttttyggttgggygygttgygggttgggtyggygtatttgyggttattyggygagttttggtttattgattttygtttygagagagtygggagtttttttttttttttatttttygttagtttattttttattgaayggtggggagggggygggagygggggaygttttttagtttttatttttyggaggtttggyggggygggtagyggagtygggygygygtagaaygtagtttttgttttttttygttttagtattttaaatyggtttttgtagtygtygtagtagttgtygtygtttaggttgtttgggggggygattgygygttatttagayggyggagygtyggggatttaaatgttattaaaayggtgatttattattgyggaagtyggtaaatttttgtaggaggtttagttattggttgatatygttaygtgttttttttttagygtttttygttttttygtttttttttttgygtattgtatatttatattatttttttttttyggttttatggaggaagtgagaaagttggtatagttaygtygggtttygtaggattaggttatttagtgatagatggataatgtaagaatgaatttttttttggaatattttatatttagtagtggygattyggggatttgtttagttygagtttatttttyggattataggattataattttttagtygtgygyggttagygttaatagttgyggyggygaygatygttttttagtgggtaggggggtgtagatyggttygt

SEQ ID NO: 11367 - DNA, 766 bp, Artificial Sequence
  Description of Artificial Sequence: Synthetic polynucleotide
ygatttygttttatgtyggtygtatygtgttttttttaggttttattagtatttgggttgttatggtgagattaagatgggtttygtttataattaaygatgttatttygtagygagttaaagttattttttattttgggttygttaygygatttttgtyggttttygttttaygyggttttagtayggygttaaggtttygtttataaatyggtttygttttttygtgttygggttygtygtttattagaygtygtttyggygtagygagttgagggtaygtttatttttttttygggtttttagtttttaaggttttagtataatgttttaggaggaagattttaggttttttttttattygaygttgtttttgggygagtygaggtttygtttattygtyggttyggttttygtttttatttgaygttgtttttgtgtagygagtttaggttygygttygtagtygtgttattttyggagttygtttttttgtttaggttttggaagygttygygggtygttaagttaygttgygagttttgtttaggaaygtttagtygttygtygaagtttagtattttygyggyggygttataggtgaatagtatygggaagtagtygtggttttgygyggagggygggggttattggagygtygyggaggggaaatygaggtyggagggaaggttaggygggygtttggtygttygggaggtagatgttagtttaaggatatagaygggttatagygagggaggttyga

SEQ ID NO: 11368 - DNA, 691 bp, Artificial Sequence
  Description of Artificial Sequence: Synthetic polynucleotide
yggygattagttttygtagaggyggggttygagtttttagttagagttttaataagtagtygaagaaygygggtagaggtttygatatggttaggagagtaygtygtygttygtaggtgttygggtttygtygagatygggaagaggtggygtygttagttttttttagatttaggggtggttygataggtttaatttygtttttygttttgttttttygttttttttttyggygaygttyggttygyggttggtyggttygtygygygtttygggaygagggygggaggygagygygttggtygtygygtatttattattgttaaygtygtygtygygttttttttattttatttttttttttttaggagaatttttagtttyggtttttttygtttyggygtttygttaygtgatttygggtygttttttataygtgatygtttttttttttttttttattttygtattygttttttttttagttttttgtttygttttgttggtygttaggtatttyggggagaggtygtttggaggyggggttttaggttttatttttyggagggtggagaggggygggtaaattaygtygagtgggyggggtttgaatagaggygggttygygggttttttttygtygttttttyggttatyggaygagyggtttygtgttyggtttttttatygt

SEQ ID NO: 11369 - DNA, 1024 bp, Artificial Sequence
  Description of Artificial Sequence: Synthetic polynucleotide
ygygtatttattttgggttgtggagtttagttggtygtygttygtttyggttaygygttgyggttttaygggttygggagygagggtttygttygygtyggatatgggtygtttygtygagttygygtygygtygttgtygtttagttygtygttyggtagggygtayggaggaagggttgtgaggtgttgggtgtagggaattgattgtttttggyggaaaaatatataaaattaaaaaaaaaaatgtttttagagaagagtatattatttttgygggaygttttttttttttttattttttttttttaaattttatttyggggaagttttgatttgaaatttgygaagaaaattgttatagygtaagttgatagyggyggggttttaggggttygaggtggatttagyggggaggggttggaaagagagatygggtttgggagaatttyggggatggggattaaattttttttttttttygttyggagattattatttattttygtattttttygtagtygttttaagtttttttttttttttttttttttttttttgtttyggaaagttagygagttttyggtagyggtygtattttygtttyggtggtttgaygayggyggyggtygtttttgygygttttttygttttttttyggtttagtttagaygtygtagtggyggtaattgyggtagyggtggyggttttgatttygygtatttygttttttttttttagttagtttattttagtyggtttttttgygagggggttttttttttttttgtttttttttttttttttttatttttataattttgaaatatttttttttttgttgtttttttttattatattyggatygggaaggtttygaatttttggttagyggtttygatgttgggagyggygygattygggttyggtygygygatttttygygttttgygttgtttgggttaggaggttagagtyggtttgggttggttygggttttttattygggygttgygttttttygg

SEQ ID NO: 11370 - DNA, 1339 bp, Artificial Sequence
  Description of Artificial Sequence: Synthetic polynucleotide
ygtygygggttttggygagtaggtgattayggatttttggtgtttgttgggygagayggtgaagtaatttttttttygttttttttttygtttagaaaggtgtaagattygttaaatygtgygttgtatagyggyggtyggagtagaygygggatggtygygygttttttgtatagtatagaggggtagtyggagagtttgggaaaggtaygagyggggaattagagtatagggtgyggattagaaagagtagayggttagtygggyggggaaggaagttgtygagttgtaggtgtggaaggggttgttttaggtttatttttggtagaygagggggyggggagtygygtyggggaygaggagattgyggatygggygygttttttgygtagtygttygttygygtgtttaagtttttygggaatggttttygtttaggggtttagttygtygtygttagtttygtagagtttgtagttgttggggttyggtagtygttagggggygggagttgygtygygaataatggtygygtttggtygygggttggygggaggyggagtggaggtagagtyggtgtygggygygygygtyggtygggygtgttggggygygggagyggttgygtaggygggggygygyggygygagygygggagggygyggygggagygtyggggaggygggyggaggygggyggaggyggggggyggggagttygaggggtggaagtyggyggyggtygagyggggttagttttttgtagtgtttgttaatgttggagtygtttgtaaagtgttttyggtaagaaggtaaatatttttatygggggygttygggagatttygattttygygtygtyggygaagaaggtagagggygttggggagttttgtagtttygtagtayggggaattyggagaaaagtagtttttttygyggttttttttttttygygtttttttttttatatygggttttyggggtagtagyggggaggggagatyggygggggagggaggatagggaggygaaggaattggggtggggggtgygtgtgtggtggagggggtgggaygatataggtgttttgaggggaggagtygggaggaaggygaggaggtygggttaagtgggggtgyggaggtyggggagataggaaygyggttgygggygygggaggttggggttttagggggtyggggtggtagyggtyggaagagaggayggygagtgtagttayggtgtggttgygagggagagggagygtttagagtagggtaggggagggyggttyggggagggtttgygggaaatgggtttgggggygttggaggygg

SEQ ID NO: 11371 - DNA, 2273 bp, Artificial Sequence
  Description of Artificial Sequence: Synthetic polynucleotide
yggtttttagggatygaggggttygtagagtgatttattttattttygggaagttgtygggagtttygyggattygtygyggtttttagtttttatgtgtaggggtttyggggttggggtttggttagtgygaygtttygttygyggttatttatagttgttgaggaatagtagtatygygaagtygagygtggyggtggttagtaggattaggtaggygttgtagggtattatgaagtttygtattagtagggaggygttaggyggttgtygggtgtttygygttagyggtagyggaggtatggttyggggtttyggttttgygttttatttttagagygtgggggttttttayggggtgtttttgggtttttttagggttgttygttttattttgggatttttggggyggyggatagtagttgtgtttttagagtttatttagttatagttttgggggtgttaggtttyggttttagttttttaggtttatygtgggaggagggtagaattttttyggagtagaaattttaaatgtgggtttygaggtaggyggaggagggattgggagttygtagttatttttgttgtttatagttttttygggttggtygttagygttyggttttttyggagttttyggagtygygtaggtyggagaggyggtgygygyggtaggtgygygggggtygggygtygagggtttgttgttttygttttyggtagaggyggaagyggygataggagygggtaggtaggaggggyggtygygtygggagygagaagaaagygtygtttgyggaggtygygtygggtttygggttttttttagtttttttygttttygyggggttggggaggtgagtgaggggygaagaygtygyggagggagggygggagtagagataaaggaagtygtttttagggatttyggygttygyggggagttttagaggatygggyggatgyggaygggagagygtygtataaaagggaaygtygggtaggyggggtygggggtgtttggttggggttggggttggggttgggttyggggtygggagygttggggttggggttgggtygggattggggttggggtggttgaggttggggtygagggtgggtttgaaggtgttgggattgggggtgggattggggttgggtttgggggygttgaggttgaagttggggtygggggtgggattgggggygttggggttgggtygggggtgggattgaggttgygggygtttaattgggattgagtygagggtagyggtggggttgggtygggggagtaggggtygygtygggtagygtygygtgttggagyggaggygggtgyggtyggggtaggtygygggaggaggaagygtttggggagtaggagttgggtygggygggttygygtttygtattygygggggtgaatyggagtygtygtagggggttyggggggtygygtgygatygygtgtgygygtygtygtgygtgtgttygygagtgtttgygttygyggtttygttttggyggggygtaggtgggggagggttttaggtgyggygygagttggagggtggagtgaggtgagyggtttagaaatygtttygtttatttttttttggggattgatagtggtttttttagtygtyggygttttygattttygygyggggyggggttatgtaaatgagttttatgtaaattgyggyggggattttttgygggttygtggggttggaaygtttttaagaggtygtttygggaaygttygggttttgaygttattgyggttyggggyggggaatgggggtttgggtttatttgggatttttgaygygtagttyggygtttttatattygttttygtaggtygtttttttttttggtygttgtttagtygggggattygggggtaagggaggggttygttyggttyggtgtgtgtattattttttagagtttatgttaggttygattattttggaggttagaatttttyggygatygtattttagygttttygtatatttttggttattygtagtttttggaagggatttttgygtatttattattttgtttttttttttgtttttgtaatgatygattttattttttaagttttagttttaggaaagtaaggattyggygttagggygtttttgtttygttagttttttttagtatygyggattaagttatttgttatattyggttttatttattttgtagaygatagttgtyggtagttattagtgttatygygt

SEQ ID NO: 11372 - DNA, 5586 bp, Artificial Sequence
  Description of Artificial Sequence: Synthetic polynucleotide
ygggtttagtttygtatayggattygttaggagtaggtggttagtaygygttgttggyggygtattaygtaggtgtaggtgtttttattgayggygttggygatgatgtttaggtgygtttygtttagggttaggtagtyggggtaggagaattttaggggtttttggtttttgtattagttgtaggggggyggggygttttttgtaggtatagtttttttygttgtttgtttygtatttttgttttaaggtygttygygggttgtttatttygaggatygttyggggygtttatttattatatttttttttttttgtggaggattttttggtygtagyggaaggttaygtttttgttttygggtattagtttggttttggttttggggggyggtggggtggtggttatygtggggaaggggaattttgtttygggtgggggaaagagtttygttagtgtttttttagtttygattatggttaaggtttagtttttaygtagttttgtttyggtttygtgggtattatygtagtagaagtygtagttgttggggtagagtttttttatgagtygtyggygagygtygtagaagttttttygygtttaggaygygtataygaatagtttgtygaggtattttgtygggagygtggggagtayggtttggtttaggatygttyggttttygttttttygttygataaagggatttatygtagagtyggtgtagtttttatagttygttttgggataaygttttttagtygygtagygtggygtttaggtgtatgagygttyggtygtgttgtgagtgtattaggtttagygygtggtygatttygtgggtygttaygtgtattaggttygtgagttataygtttgygggtttygggggttagygtttgggagtttygggtttagtttygtygttygtgggttagtttttygaggttyggtgtatttgttggagygtagtygyggagtygttttyggtygtagttayggaaagataagaatgttttgggtttaggyggtgagttyggtttttaggaatgtagttttagttttygttttagaggygtagggggatgggaaagggagtttagggttgtygggatgggggtttttaygggtttttttttttgtttgttagattttagtggtagttattatttyggaaggttttttttgtygtttgttttaaagttygatygyggtagtttattgtgttgtagaggagaggtttttaggaggttagtttggayggttattttttttttagttgtagygygtggggtttaggatttagtattygttgtygtygaagtggatgtygtygtgyggggggaagaaggygtgggttagttttttygtggggtygtygaagtagtggtgtagygyggagattaggtagttygtgtggttgatygggtagaagtttggggggagtayggggttgagaggtygggygygtagggtygggtyggggygggggygggygtttatttattyggaggtygttgggttgttygggggttatttygyggaagttgaagggggataygtygttttatatgyggaaggyggtagttagggttygtygygtttttygygggtttagtaggtttygygggaaggagaggattttgtagggagagtgagtttagygggygtyggtygygttttttttttyggggtttagttagggygtatttgtaggtgaggttgaagtggttttagygtagtttggttggagttagygtgtagyggygtttgyggggggttagtgggttygggattygggtgggggggatygtygagaggtttagygtagygaygtttttttttagggaagaaagygtgygtgggaggtatyggtgayggtttttaggattaaaaattgtygyggaaaatggattggaaggaaaygggggtgggggtgtttagggttgggagygggygtggygggttttgtttgtttgtggtttygggttttttaatttgagygttttgttgtaygtttttgggaaygyggtttagtggaggggaaggggttgaatagtagggygaggttttttattttttttaataattggatataggggygtttaatttttygatttygggaygtatattyggatttttaaatatttygtatatttygtataygttttgygggtttttygatagattagatttatagaygtgaggatttttttaattyggtatttggtttttttttygtygtttatttgygttgygttttaggtyggtatygtyggggtttttagtygggttagtagtattagygyggggaggaggtatagggygattagygyggttttaagttagyggygttygaygtttgttttyggggttttygaggggataygggtttygyggtttatggtagatttgttgtggggtttagggttgtatggggtagtaaggygygggggttygggtygtagagttttyggggaggattyggaggggaggtagtggttyggyggttygggttatagttyggtgtggtgggggggagggagayggggygggagagggggtaaggttgtttttgaagggaattagttggttygttygttggtygagttgtttgttgtttttagtygggggtatggggattygygtttygtgggttaggggtagaggtttgggtatggtttgttgggyggggttttyggaggggggagygaagagggttttaggtagttygggaagggtagygttagggttttygtttaggaaagggtagtagtgggggtttttaagtttttattgttgggtagtgagtgatttggtggttttttttttaaatggaatttttaaaaaatttttgagttttatatgagyggagtttttattttggtttaggtagttgagttgggtygtaggagaygygtygttygtttgatagtgttttygagagttgggaggggatggtyggatggggaygtggtagtgagtatggggyggtggagggggaggyggggagggggtgygtgggtaggtaagggtygyggagggtgttaggttgyggggyggagggagggaatttgttagggtttttyggggagtygggaaggggygggttttggttgygggaagtttygtggagggtagygygtgaggtggagggtgtgtggtttttaaattttyggttaggttttagtaaaggggagagggagaygggagggaygggaaayggagttaagygtygggtttggaggtttggatyggttttgattgggggygggggyggggagttyggagatttaaaggttygayggggyggtyggygtttaggygygagyggttttgggttgggatygagatygggtatyggygtttygyggggygggggtgggggattgggtagaggagtaggagatttygagttagatyggtttgtgtttgtttygttttttttygtttttygygtyggygtygggtttagggtgayggtagttyggttaayggggttagygttaagtagttggyggyggtygygggyggtttttggaaagygygagaggttgggtttggtygtygtatttgtttygatatygtttttygtttttttagttygttatttygtttgygtgygttyggtttttagattttgtttgggaygttttttaattaattttttgttgggaygggattttatagttttggggagtgtygggttttttggattagagygygagttttygyggtygtttttaggayggaagagygaggggggttygggggtagatataggagttttygtttygtyggattygggtttggggggygggaggyggtygtgttygygtttgaagggtgttttggttygaaggtygtagttygggygggagtttggattygagagtttggggygggyggggyggatttagggaagggtttttttttttygtttttaggttygttygygtgtttygaggggaggattttagaggygttyggttttttaggtagatagtagaggtaaygttygagaatttttttttttataaaatatagggygggggtaygygaaggtagttygggygyggyggayggygyggtttataygaagatttggatgyggtygyggatgggttggyggtagatggggtaggygttgagygyggagtygtagggggygtatgygtygtggtygtattggaataygaggyggatgtggttgtygatgtagatggggtaggtgatgygtttttttatttgtyggtagyggttttgtagtttttttattagttggygyggygggtygggggygggggyggygttygttattttagagtygtttgyggggtgggggaygggtgtgagttgggaggtygggtgggggaatgyggggagtagggagttgygggggggygaggttgggggyggggtgttatttgggaygggttgtgatttgtaaggggggttggyggggtgggtgatttggaggtagaggtggggttygggtgygggtaggaggtgagtygtggaaattaggtataaggtggtgtgygggttggagttagggttgtaggtgggttgtgagttgggtyggggtgtgatgggggggyggtgttttgggtgggttgtgatttggggtggggttatggagggagtgtgatttgggaggggtygtgaaatttagyggggttggggtgtgatgggggaggagggtgttattttgaggyggggttgtgggtygggtgtgatttggagtaggtggggttgggggttgggggttggggggtygggtgtgagttttgggagggyggggtgtaatttggggaagggttatgggyggaagtgtgggagggaaggggtgggggayggggattygygggttattagttgagtaggaggygtgttgggggygtagagttttatttatttgggygtagttttttgttgaygattatttggtatttgatgtatttttttattttgygygygtattttgygaagaggagagygyggttggttgyggttttattagtygggtttttttatttyggggttttttatttatttttatatayggtgyggtgttggtayggygagaatagtattagtagygttagttyggagtatattaggtatttagyggtttygggtttyggygyggygtttaygtgtaggttygttayggtgttgggggtttygagygtttgtttggggttyggggtygygttttygttygtttgtygttttttgtagggggaggaggyggtttgagaggggttyggaggtygtyggattttattttygtygtttayggatttatyggaagygttgggygtagttttgaagggttttgagtaygygattttyggyggttaggtttagygggtttygatygyggtggttggtgtagtttaygtyggygttttttagygttaggaagtaggygatygtygygtttatygttagtttygygttgtyggggaggttygaggtttgtagttgggyggtaggatagaygtyggtgagggygggygtyggggtaggttygagggaggygttttttggtatttggtagttttagtagtyggygt

SEQ ID NO: 11373 - DNA, 1264 bp, Artificial Sequence
  Description of Artificial Sequence: Synthetic polynucleotide
ygygggtgaatygagygttttttygtttttttggtttgtagttagagatagtttttygtygttygatttygtattygttgaggagygtagggttgtgttygtatttygtttygtatttgtttgtttagggaaatygggagtttygygggtttygtygygggaaggaggyggtattgggttttaaaaattygtgttgaggagaagtygagygttttaatatattygtygtyggtygggtygggttttygygygtttygaygtygttttagtttygttygygygygttygataygttygttttygttttygttttgatatagatataygygygygttttygtattattttagaagtttattyggttygygygygtatttagataygygtggtttatattygtygtataygtttttygtataaataygygygttttttaygttttyggttattttagatatayggtttygggttttaygtaggttygggygtygatatattttygyggtatggataygygtgttttttatttatttttyggttaaaygtatttttttttgtagttttttatttttgttttttatatttattttttattttygttttagaaataygttttttatatygggttygtyggatttttatattttttattygygttagaaaygygygtattttygtggtttttttttgtygygygtaaataygttyggttygygtaygttttttyggtttggtttygtatattygygttagaaataygygtggtygygtattaygttttyggttygygagtaygygtgtttttaygtttyggtttygttttygtttygygygygttttygttggtygtygttttygatygtaygygtttttygtttagtttygygtygtygygtatttattyggatttgttgagttyggtttttgttygttaggtttgygtygagtygtygtttattggttttygygtttygttyggtttygttyggttyggtttagttyggtttygygttygtttagttttattygtygtagttggaaygattygyggggtttygggtatygyggttttttygttattgttygagtgygtygttyggattaatggyggggygyggyggtgagtttatyggattagatttygttttttaggtygygtggtttaatyggaggatgygaygttattyggagtygggtagaggttggtgyggggygyggagtygttyggygyggggattgygtyggaattgygttygagtygygt

SEQ ID NO: 11374 - DNA, 716 bp, Artificial Sequence
  Description of Artificial Sequence: Synthetic polynucleotide
ygaygggygygtgaggtttagagaggagtagtttygggattygtttttttttttgtttgattttggttaggaaaaggggtttggagygttttygggtttyggaaaygygggatttttygtaggtagtygagtagggyggtygtyggggttatygttgggygtygtyggagttttaattygatttatgtgygggatttyggttttttgtgygggagttttygttttgygygtygggttttyggttttygttttygggttgggattyggtttttygtyggttttattgagttttygtttyggatttgtygatttttygatttyggggagagagattaagagattgggaygtaaagggygtgaggatygtattttttattygtaggtttttttaggggygtygygtygggggtttyggttggygatygagtaggtttyggtygagtattgtyggygttgttatttgtgtgtatyggggatagggayggagggaygygatttttatttattyggttygtttatttgggtygttygygtttyggyggtttygattygaygttygagttagyggagttyggagtygttgggtttttygtttttttygttygttygtttttttygttttttyggtttttttygtttygtygttttgygtygttttattataaaaggtgaggttyggggggagggggygygggattttygtttygyggaagygg

SEQ ID NO: 11375 - DNA, 619 bp, Artificial Sequence
  Description of Artificial Sequence: Synthetic polynucleotide
yggtggatygtttgggygggtaaaygtttttttaygttggygggtaggatttgaattygggtttttagggttttgtaggtygttattgttttygttttttttttgttttyggtttttttygtttggtttgtygyggttygtygttttttttttttttttttttttygttygttttttgttttttgtttttttttttygtttttttttattttttgtttttygygatttttttttttttttygatttttyggygtygttttttttttttttttgttttygtagtttaaataygygatatttggagtaatagtagtygttyggyggtttgggttttattataggtyggtttttatygyggygtgtattatattattttattttaaagaattygtagagaaattygtttyggtygataatagaaagtaaaaatatagttgatttttattagggtttttttataggtttygygtgaggtaatgaaatatggaagyggtgagatatgtaatgttttattaagyggttttagttataayggygtgtatgttaattaygtttgtaggttatygttygttttyggttgtyggattatttagygygttttttttygagtttyggaygg

SEQ ID NO: 11376 - DNA, 293 bp, Artificial Sequence
  Description of Artificial Sequence: Synthetic polynucleotide
ygttttayggggtaaatttygaggtttagtttygygtgggagtygtagyggggygggttygttttgggttgggygggtttttttagygtagygttgggggttgygggttttttagtagtyggagtagtattttgagtttyggttgttggagygttgggatttttggttgtygttttygtagtagtagtaattattatttygttgtyggyggygtttttttgggaagtagtagtaattggtggagttggagtygtagtagtttgagtygtygtagtagtttttgtyggagtygt

SEQ ID NO: 11377 - DNA, 2748 bp, Artificial Sequence
  Description of Artificial Sequence: Synthetic polynucleotide
ygaatyggtttttttyggtttygtattttttagggtygttyggygagtttttgtatgttttttattygttaagttygttattyggtttygtttttttataygygtattggtaygtttttttttagtttttagygggygggtagtttgtygggtatttaggaagttygggtttttyggygtyggaggatttataatttagttatygtaataagttygygtagttaaagtagttygtttgggtattaggttttatygtttttgtttygtggttttaagagggttygtgttagttttygaggtatggtygtttggygttyggtatattttagatttatttttttttgagggtaggggtttttyggggagagaaagagtagtttyggggttygtttygggtttttttgtatagattttttaggtayggagaataatggaatagttttgygygttttttttattygagtaagttttgttttttttttttygtttgttyggtttttattagttatagggtaaaggtttttyggttaaataggagtttyggygttaaygtttagagttttygataygttttaaaagatttgygggtgtaggggttggggttagagtyggggttgaggtatyggatatgygtttagatgygtatagttggtagttygttygttttyggttttagaygttttttttagttagaatttttatatygyggggaaattygatttgygtttttattygggatttatagaggaagtggagttttagttgtgtttyggggttaattagtttttatatttgtttttttatatttgttttttagattygggttttygttggaygttttttttgtaatgygggatgtttttgttaagygtaggttatattataayggaggtttttattagttttaggttttgttatattgggattttggttttatttttgagagtttgtaatttttttattttttattttattgtttagttttatttygggtaggttagagtygagttygggttttygtttgtaatgtttttaagaaggtatatttgagttatgygtatttggaggtgggttagtttagtatatttgggygtaatgtttattatagtttgatygtgaataggagggtttttygggaaggygtaaggggagggggtttygttttttttatattttttttagtagttggttaggagaaagttaggggyggggyggggyggggyggtaggatttatttagtatttggttgaagagtagttgttttaggttttttagtayggttattattagttyggggtttattttgaggaaggygygttttttttggtttttggtagaggggataggtttagagtttttttgygttttggttttgttggagagtagttygtygttygatttgttattttygtttayggtygttttaggygttttgttgagyggtttgattttygtatagggttttygagggattyggttyggtttttttaggttgggygygagyggagttaggggggttttggygtygttygtygggttgtttttggtttggaagagygagtgtttygatttggatagygttttggatattagyggagttttayggtttttggattttattttgtttaagtttttgggygttttggttatatygtygttttattygggtttataaagttgtagttttttttyggagttygtgagaaaagagaggttggtgagtgatttttgtttgygtaggttggaggygggyggttygtyggggatayggttgtttaygttgtyggatttgaagatttttagtttagtygygttggttttggttatgtygtygtygtygtygggygttttggygygtttgggtagtatgtttttgtygttygtygttgtygtttttttgtyggygtttygyggttygttygygttttygtygtygtygtygttgtttagttttatttygggttgtaygtttttgaygttgttgtttagtattttgttygygaggagygtatggaygattygygygtttgtaggtayggggggagggggtagggggygggagygtaggaggaggaggygggggaggaggagggggagagagaggayggaagaaatygaggaagaaggggagagaagggggagagagygagggaggagggagagaggtaagtygagggygtaggggaaagaaaygygaggaaggaagtygggaaaaaggaaagagtagggaagtyggggagygatagggyggggtyggaggaaaaggggyggggyggyggggaaaatataaattaaaatttaaaaattagttaaaggaaggatggaagtttygyggttttttyggygtttagyggtgtttttgttttggtgttyggattttagttygyggtttgtttgtttgttagtttygtggatatygtattgtygggtagygtttyggtygtatttagttagttagttagttygagtygaggttgtaggttgtagtttygagtagaggaaggagggaaggggaaggyggggagtaaataggaggaggggagygagtgtgygtayggggagggaggtgggggagagatagtgtgtttatttttggttygggagggggaggtatttgygagyggagttttaggggyggatgagtggggggtagggggaaataaaggaaaagtagttttttttttagtttttygygtagaagyggggygggtttttggattttyggagggtayggggattttttgtygt

SEQ ID NO: 11378 - DNA, 433 bp, Artificial Sequence
  Description of Artificial Sequence: Synthetic polynucleotide
ygggattgggygttagttagtagttygtaggattaggyggggataggygggtagtatttataggtaagtygttagggggtttaggtttttyggaayggyggatagttygagtttagagtagtyggtagatagtatgatgtygtttttttggtagtggtagggggtygggtaggyggtgggtttygggtygggttggggggygtygtyggtttttygggaagygtatagygyggygtaaagttatagygttyggagtttyggygggttgggtatttyggyggtygggttattggggtatttggyggtygggygyggaygtayggygygatggtygtagttgttttttttyggtttyggygggttgtatygtyggtggggatygttttaggggttttattgggyggyggyggyggyggtgggagygtygggaygg

SEQ ID NO: 11379 - DNA, 1376 bp, Artificial Sequence
  Description of Artificial Sequence: Synthetic polynucleotide
ygygggatttttatttttgygaggtttttagagtttttttgggaggaggttttygttggaaygtgtttgggtgaggagagggagatyggtttttaggtagggayggttagggtgygygtattttagtttttgggttatttyggygggagtttgygttttttttaggygygatttttaggaaggtttygggtggtgatygtagattggagagtgagttgggttggggaaagagtgaggyggatygtttttaattttyggtaaagtgtgygttttygttttattatttaggggyggyggtttttgatgagtttatgggggyggggygttaggagtttygttygygagtttttttttygttttygygaagtagtagttyggaattygyggttagggattygygtaggtttttttttagttgaggggyggtygggtattygggtttygattygygattatygtatttattattattatagygggaattgttyggyggtttttagaagtttyggttyggtygtagaggtgggttttygagtatagaggtttygaaattyggttygtagtttttagttttaatgtyggggggygyggtggtttygggygattttttatttygtttttggagtttataggtggttttataatttygyggttygygttgygttygyggggtttagtaygttgtygygggatttgtttaaygtggagtgtgtgtttgttttttttygtttyggttttyggygtagtttttatttagaagaygaaattgaagaygaagagtaggtatttgatgtatttggtgtagttttttatttttatggyggygygggyggygggyggtttgyggggygygggtyggttttgggyggygggygggtyggygyggggtttggygggtggtyggtaagggggtttggygggtygaggggygggggygygaagaaaggggygygggggygygggggygygggggygygtggggygttgggygtyggaggtttggtaggatgygyggtggggtygtygtygtygtygtygttgygygttygttttttggtygggygygygtttygtttygtagtatttatagggygtygyggtttygtttttttataggtttygtttyggttagtttaygtttygttttyggtttygttttttgtygttagggygygtagtygaggggtatggggtygttgtatttatttttaatttggygygtttyggttaggattttagggtttaggtgtatygtgttgggygygggaggygtttttaagttgttgtygygtttygagtttttaagggggtggtagtagggtygygtttgaggataggtatgtagygtttgtttaggagtgtagtttyggtgtygg

SEQ ID NO: 11380 - DNA, 3393 bp, Artificial Sequence
  Description of Artificial Sequence: Synthetic polynucleotide
ygtagyggaggygggaggagagtttttggygggtatttgtttttygygtttttygygygtttaaggttgggtttyggggtattttattygggtygtttygggtttagttttagtttagaatgattttatattttttatatttttaagttttagaaattatygttttgagaattttaaggaggatattttttttygggttttttgtagygtygagtttyggtaggttttttyggygttygtttgttgygagatttttttgtygtttygaggagtaygagattttagtygtttgtagattatttatatttgyggagggtggtagtaggggtttggttggtttgaaaygygtyggggaggygygygttgtattaaatttygtttttgtttttaagggtagattyggggtaaggggattaagattttygaygtatttagygttatggggatagttatggttaatattttgtttttgyggttaattttaaggttattaaaattttttattygtagagagygygtatagtagtgyggatattyggggattgttttaaggaaggttgagttttgggagygygtggatttygttttatygttyggygattggttygyggggttgggggyggagatygagttygygttgtataaatatttatgagtyggtagygyggygygagyggggttggagtygggaagttgggttaagggygttgttttygtygaggaggaggyggyggttgggygygggtygygttatttaggtgttygtttygtttttyggtttggatttgtttttgggtgtttagtaggaaggagattgtgtgtatttygttygattgyggtyggagygyggygttgatttttttaggyggygggggttygtttgtttyggyggyggayggaygaaggayggaygtyggagaaagagggyggyggtttgggtygaggygggtttttaatttyggyggyggyggyggyggtttggttttgggggygggtatgagttttygggggtygagtggtggtygttagggttgattyggygyggtaagyggttyggtttagttattttgattgygtatygyggttttagaggaaatttgyggygttttygttttttttgttyggyggagttatygtygttyggygyggyggggagaagtggtygggygygyggagaggaggygagygagygygggaygatgagtygaggttyggtygttttgygtygygagggttgagygygattyggggttagtagagyggatttayggattgtggygygygtttgtagtygtttttaaattttyggagyggyggaaaggagtgyggaagggttttgtttaggttgygggtygygtygttgyggaygygtttttagaaggggttagattatyggtagatttttttttygggygaagtataagggagattttagattattygttgtattygtttgyggttttttygtgggtttttttttyggtatttttttgygygtygtttggagggygagggtatygggtygaggygtatagtatggagtggggttatttgttggaagtgatttygttgttggtygttttggygttgttgtagygttttagyggygttgyggtygtttyggttaaggagttggtatgttaagagattatygtgtygttgtgtaagggtatyggttataattatatttatatgtttaattagtttaattaygataygtaagaygaggygggtttggaggtgtattagttttggtygttggtggagatttagtgttygttygattttaagttttttttgtgtagtatgtataygtttatttgtttagaggattataagaagtygttgtygttttgtygttyggtgtgygagygygttaaggtyggttgygygtygtttatgygttagtayggtttygtttggttygatygtatgygttgygatyggttgttygagtaaggtaattttgataygttgtgtatggattataatygtatygatttaattatygtygygtttagttygtygygtygtttgtygtygtygtygttyggygagtagtygttttygggtagyggttayggtygttygtygggggttaggttttygtattgyggyggyggtaggggyggtggyggyggggaygyggyggygtttttagttygyggyggyggyggtggygggaaggygyggttttttggyggyggygyggttttttgygagttygggtgttagtgtygygygtttatggtgagygtgtttagygagygttattygttttataatygygttaagataggttagatygttaattgygygttgttttgttataattttttttttagttaggaygagygygtttttatygttttttggatyggtttgtggtyggtgttttgtttygtgtttattttygttatygtttttattttttttatygatatggagygttttaagtattyggagyggtttattatttttttttyggtttgttattttttygtgtyggtgggttatttagtgygtttggtggygggttaygagaaggtggygtgtagyggtggygygtygggygyggggggygttgggggygygggyggygyggyggygggygygggygyggygggygygggygygggyggttygggygggygyggygagtaygaggagttgggygyggtggagtagtaygtgygttaygagattatyggtttygygttgtgtatygtggtttttttgttggtttattttttyggtatggttagttttatttggtgggtgattttgtygtttatatggtttttggyggtyggtatgaagtggggtaaygaagttatygtyggttattygtagtatttttatttggtygygtggtttgtgtttagygttaagtttatygyggtgttggygtttagttyggtggayggygattyggtggygggtatttgttaygtgggtaattagagtttggataatttgygyggtttygtgttggygtygttggttatttatttttttatyggtattatgtttttgttggtyggtttygtgtttttttttygtattygttyggttattaagtaataggayggttttattaagaygtataagttggagaagttgatgattygtttgggtttgtttatygtgttttatatygtgttygtygyggtggtggtygtttgttttttttaygagtagtataatygttygygttgggaggttaygtataattgttygtgtttgygggatttgtagttygattaggtaygtaggttygattaygtygtttttatgtttaagtattttatgtgtttagtggtgggtattatttygggygtgtgggtttggttyggtaagaygttggagttttggygttttttgtgtattygt

SEQ ID NO: 11381 - DNA, 1381 bp, Artificial Sequence
  Description of Artificial Sequence: Synthetic polynucleotide
ygttttaaygtgttgttttggtattaggaygygtatggggaggtggagataaayggtgygtggggttygygtgggygygaggaggggtygttayggtttttttgagagtgygttgttgagttyggttttggaggygtgyggyggggaggggttagttttygggtgttttgtgyggttyggttggggttaaagttyggggygggtttgtttttgtgtaygtgggagatggttaggggtgttggggatttygagggttggtgtgaggtttygggagttatyggggtgattggtygtygttygtagaygggaagttttaygaygtttaygttttttatagygattgtttygaggatygtaagttygtgaattttattttaaagtygtagttggagyggygtyggggttataagttttttttggaygatygygattttttgtygygygttggtatttygggttttatttygtgtttygtttattyggagggttygtttygtttygttttatgtttygttttattyggggttttatttttattatygagtttygtttttattttygtttattygaggtttygttttaaaaattygtttatttygtaggtttygttttttttttagagttttgygttyggtatygtttttgagttttyggtttygttttttttygttttygtttttgygtygtygaygttygttttttygtagagtttttygtygattttttggtgaatttgagtygttgtygaygttttatygtggtgttttyggaygtttttttgagtygggtttggtgtagttatagttttyggtgggtttygygyggggttgggtgggttttagygtagtatttatttttttgayggtttygtttygtagggagggtttgtgtyggttgttggagtttattygtagatttatttttattattttygagggttagaggygygatttygygtattyggygtttygtttgttgygttagtatygttatttggtgattttgttgttttggaggttyggtttygtggtgyggagtaggygygggagggttyggggttagyggygggttagagatgggyggtgttygggttttaggttgggattttttygtggggagttttgyggtattaygttttgtgaatgggttttggggggaggtttygttgtttggggtttygatgyggggagtygtttttgaggttttyggagttayggaatagttgtygtagggygtggaattygtgggtagtygtaggtgtgtttttgggggttaggaygttaggggttttygaggtgtttatatttgtaaatygtttygatttggtttttagattttttttttygatttttggaaagaagtgtagttggygttgtygygg

SEQ ID NO: 11382 - DNA, 493 bp, Artificial Sequence
  Description of Artificial Sequence: Synthetic polynucleotide
ygagttgtttttgggygygtttggggttgtatttgggttaygtgggygtygttgtgtagtyggtatttttyggttaatttygyggtttggagaaggggttttgtattygtygtygttgtttgttttygygyggttttygtttattgttttgyggttgttttgygggttgaaaagtttttttyggtgtagaatttygggtttagygatagtttgygtygagtgtgygtatttgtyggagattygttagttygtyggtygyggtgagtggtttttggagttattggtttagggygggttygygggatggggygggyggttyggggygtagtyggttaggtygttgttatggtaaygyggtggaaaaaygggtttttgggtatttygttgtyggtyggttggtaattttttagyggagggatygggtygagttygyggattttttygagtgttttttggggtttagtygttggtattttatttttttygggttygg

SEQ ID NO: 11383 - DNA, 922 bp, Artificial Sequence
  Description of Artificial Sequence: Synthetic polynucleotide
ygtgttttttttygttatttggtayggttygtgttttygtygttgatttggtaggttgygygygtatatttyggtygggtgygggtyggyggggtatagyggtttttayggttygttttygttagttatttttyggttttttttttygttgttygygtgtttygggtyggtttagtatttttygagttaygtgttygygtttttyggyggggaggagygtagtygygggggygygtttyggtgatttygttttttagttttttttttttgagttygggagttyggttygygyggttaggtgygaggagattygggattttaygttygttygttttgtttagygttttagtttyggygtgygaggygtygtttttttttttgttttgygyggtgtatggaggggttygttyggatygtagtygtygttatygtagtygtygtygygygygygyggggggatgatttgggggtggtttttygagtyggttgtagygtaggaggtttggaggtttagttagtttygyggagaggtgygggggtgggggtttygtygtagggtyggagggaggggtggygygygggtattgggtttggggggttttggtttaggggaygggaggtttyggggaygggygggtyggygttttttggagggygtgggggtgtagggttgygtgyggggtttggatgttgatgtttgttyggyggggagtttyggygtttygygttttygggggttyggaggtatttygygggaggaggyggggtgaggtgttagtgataygaygaaatttttttttgaygatggttttygggggtaggtgagatgtygtagagyggggagttagggygttygygygtttttttaagggagtygggtttttggttttttttaatttttatttttgtagagygttygyga

SEQ ID NO: 11384 - DNA, 719 bp, Artificial Sequence
  Description of Artificial Sequence: Synthetic polynucleotide
ygttygaggatgttggaggtgggggtygtygttttagttygggygtagggttgggggattgggggyggaaatttttygtagaattgtttygtttgtttattttaagggaayggagaggattyggtttttygygaaaatttggtttagggaaagggatttyggaaagtagtttygtagggttgtggtagttttatttygattygygttgygtttaygtgtagggttygatttttttygggaggygyggygtyggttggggttaggyggtygaggatttygyggtttttygtttygtttygtttygtgggttttygygtatygtygtygygtatttatttttaygggtggagyggggyggggtagtayggtttygygygtagtttygattygttaggygtatygatyggyggygtagygttggygygayggttygattyggtygggtttttgtttygggygygggttyggtttgggagygggygagttygtttgtaggggaggyggggattygggttygggttgggggyggggaaggggttggataygtttgygtatayggyggttygatttttaggagttttygggaggggtagaaagggyggggtggaggagggggaagggygggggtgatgtygygyggtygtaggtttgggatggtgttygygttttygagattyggatagaggtaagtaggggygtygtgggtgttagagaggygg

SEQ ID NO: 11385 - DNA, 958 bp, Artificial Sequence
  Description of Artificial Sequence: Synthetic polynucleotide
yggtgtayggggttatatagtyggaaatttttgtyggtttygggttattttttttttgaaayggtttttttyggagttattttttggaggattttatttygttyggtgttygggtttygtatttattttttttttttyggttygtttttygtayggygtttattttgtttttygttttttygttttatygtygttttgtttatattgtttttygtgggygttttyggtygtttttttttttygggtttyggtttgggggtgtttagttygttyggygtyggtttaaggtygygygatttygtaygttttygagattygtttygtygttygtygttygggtygtatttatygygttygtaggatttgggggttttygttttgttygygtttyggtatygtygtygtygtygtygttagyggaaatagggggyggggtttgttygggaatggygagtttgyggggyggggyggttygggggyggagyggggaggggyggggyggagyggggaggggyggggyggagaaggatygtagggttgagyggggygttagygttagtgttyggtattgtttygggttgggttttttgygttagaggaaggggagttyggggayggggtayggggttygygaggtaygggtgttttttyggggtttyggaagttttttttttygtttygtygttygtatgttyggatyggtygttttttygaggtgttatgatttygttttttttttgyggygaaygggttttttttyggggtaggggyggggaggttygggtttggtagtgygtttttttgggttttgygtttatayggtatttaagggtttttttggtttaggtttyggttttttttttygygttaggttgtttggtttygttattttatttttatatttaygaattttttttttggtgtttygggyggattgtgygagatgttgatagygygg

SEQ ID NO: 11386 - DNA, 3843 bp, Artificial Sequence
  Description of Artificial Sequence: Synthetic polynucleotide
ygygygtggttttyggagaggygtttattatttgygtggygttttttygygtyggagtgyggttttgtttttagygttagtgygtygygyggttygtyggtttygtaggattggttatygttttttatttatgtaatttgygtgtgygtgtgygtgtgtgtgtgtgtttttttttygttygttttttttttttgtgtgtaagagagygagggtgggggayggaggtaggtaggygagtaggtagggaggggaagaagagaagggaagttattaaatatatatatatatatatatatttatataygygygygtatatattygttttaattttttagaagtttygggattgtagttgttttatgtggggtagtagtgttggtagggaygtyggtygggagyggtygggagygggagtyggtygtgygygygyggttggaggttygttggggtttygtttttygygggagttattgttggtttygttggagttgagygtagagttyggatttgtttttttttgggygtttygttayggttygyggagtagaggagtygygtygtygagagagagaggagttatyggygyggygttttgtttttttgtygtygttttygtygttttttyggyggtagtagtttgtagttayggtaaggyggygtgattygttttayggaaaagygttttggggatygyggygaygtttygttagttttatygttttttgtattgttggttygggtagggttygggtagtttaygyggttgtygagggtttygggagatgtttgtttgtttttttggtttaggaggagggaggttagggygygggtggtygaagaggtaagttgttttggagtttggagtygtygtagttttyggagttygtygyggattggagtttgggagtaagggttgggggagggtagggaggtgggaagygggtgggagggaggyggygygttttaggttygtttgtttttttyggatttygtttttygtttyggttyggtygtttgtagtttttttgtagattagttygttttaggttttygtygggygttggaggagttygygaggyggygtygggttttagyggttgtagtttgttttgyggggtaagtgtyggttgtagtagtttygtaygggyggtggttggagtttagattttggagatgygattttagtttttygttttttgtaattygyggggygttygtttttttttatygggygttyggtygyggtattgatgttygtttaggagttaattgaggttgtagtygttagatggaygtttggagggttttygggtgtgagtgtgattgtatgattatttttatttttagtttygggaaatgtgttttgggttgaaatgtgattatygagttttttagttattttaattgttatttttaaatgyggtygttatattggaggagtagattggaaggtagtggggyggtgtgtgtgtgtgtgtgtgtgtgtgtgtgtggatatatataygtaatygaggaatatataattaattatttgggtgaagggyggggggtttatttagtgagttttttttggygggggggtygggygagttagttgttygttgttygttttttttttgtttgttttygtttaggygaggttggaaagtattggaaatttagttgygtggtttttaattttggaaattggtttygtttttagggtaaaatgttaaggygatttatgtattygygtttatgtggatgagtgtattattgtttagttgggtgtagagtttttaatagtatygygttaagtttttattygatttttaatttttttttattttttaatygtggagagagggtttatagaaatgtagttatttgtaaattatygaygtagtgaaaggggygtagggaggtagttagagttttgtttgaatttgtatattggtttggtgtttgtagtataygagattatttygttgttttgtagaaggyggtggtggggtaagttygggattttaatygtyggggtggggggtggggggaagagggtgtttatgtattgagttttgaggtygagtaaggagagagatttgttgagyggtatygygggtaattatataagttgtttyggtgattattyggaattgtgatgygagttttyggttttygaaagataagtttgaaagtttgtttgtttggggagtgtaagtatyggggygtttttatttyggtttgggtagttaggataygtttygtattayggygtttatttgtgygatgggygtygggtgttgatgttgttgtttttaaagaatyggttatygaggtagggattaagtgggggtattyggaattgatygtagaggaggagttagttagaattgaggttttattgggtttttagagttttaagttttttttyggaggtgttggaaggttttttagggaaygtygtttttagaaattgatttggtgttttggggagttttaaagtttttttttttygttttttttgggygtttttttttgttttttaagttttgtgttttttaygtgtttagaaatttgttygyggtgtttggttttttttggagatgtttaggtagtttagttatttaggtttaygttggygaggggttagagggagtagaaygttggttttgtygggttgttatttttatttatatttatttttggttttttgygttagttyggygttgatggggaygggatggggttggggtygggtatggttttygttttttygtttttygtttttgtagatagtagtttgtttttgttgygtttatttttttygtttygtygtttttttttagygtygtagtttgtgtattaygttgatgggttttgatagagaaattatagtaagagtatgtttttaaattttgattttygtttgtagggggataagttattttagttttgatatagtygtggggaaygttgaagtttgggatatattggttttgaatttttttttttttagttygtagttaggagatggtgatgtgtatgggtggggagtgttttgtttttgttatattttagygttttgaaatttttygtttttttttattgaaattttygatttgtttgaatttgttttttgttgtaaaataaattttttttttygtagatttgtggggtttttyggattttttgtygttgttatgatttttaataatgygattgaaaagttagtgttyggttggaaaaaaatttttaggtgttagtyggtygygttttgattttgttgaaggagtttttaattyggttgttagaggggttttggtttagtygtgggaatttaggaagaaggagggygtttyggaggyggttgggttagtttttygggtagggygggaattaggtygyggyggggatygtagagggggaggggaygggatttygyggtaatttgtttttyggygagtygggttygygtattttagttttttygttttagtttttygtggttygtttttttygtyggtttttagttgttttygtggtataggagtyggtygygattttttygygtttttygtyggagttygygggaygtygttaattttgggtttttyggtggtyggagtagyggtgygaattagyggggyggtygggtgggyggggtttgggygggaaattggagtygagaagatygygttttaggttaagttttagtygtaagygtygygyggtatagtgtagggtttyggtygygtttttttttygttttyggttyggtygygtttttgyggatttatagygygtttygggygttttgtagttgggtttttagygggggagtttttttygttaaagttayga

SEQ ID NO: 11387 - DNA, 384 bp, Artificial Sequence
  Description of Artificial Sequence: Synthetic polynucleotide
yggttggtygggggaygtgttygygttgtttttttttyggtygttagggggygtaggaagaagttttggaggtttgtttygggatygygtattygtttttttttttygttagttttttttttattttygttgagtttygtttygtygtttgttttttgyggtattygttygtataygaatttagttygggaatygagttgygggagtgyggtttgtgtygtttyggttaggagtttgtygattgtagaygttttgygaatyggtaagatgtgttttttggggttgtttttttttttatygtttyggggttaagttattttatatgagtataataaygagttggtgaygggtagtagttatgagagttygtttttygattttygg

SEQ ID NO: 11388 - DNA, 1432 bp, Artificial Sequence
  Description of Artificial Sequence: Synthetic polynucleotide
yggaygttagggggtgtttttagttttagygtagaatttygtttygtataatttatyggattagttaggtygtygaagggtattaggttttagttattaygaygtttygttygaygggtygtagttatgtaggagtggtagaggttgtttgaygaagttttttttgggggtygatgttttttttygggtgggaaggggygttgtyggtgagggttattttggygtyggtttgygtygttygaagtygggggggaggggaggttttygtttagtaggggttaygttygtttyggaygggggtygygygggygtttaggygaygtattttygtyggggttygtgatygttaygttyggygggyggygttgygttttttttyggggtttygtttaaggttgtagttyggttygygtygtttttagggygtttttttygttygygttgggagttyggyggtygyggtttttttygttagttttagttgtagtttgtttttgttgttttttttygttygttygttygttygyggtttgtagttttygggttygtttygaggtggagggattgtttttttygggggttgtaygtattygtagyggtttyggtttttygtyggatatatatyggtttttgtaggttgtaaagaatagyggygagaatgtatyggttttttttttttttgttttgagtttygggtgtggggggaggggaagtyggygaatagyggyggyggtagyggyggyggyggyggtagygggygaygtaagttyggatgtagtttygggggtttyggygttgagaaatagtygattttagtggygtaggayggataygaggayggttygggggattgtgtatygggtgtgygagttygtaagtygtagtaggggtygygygygttgggtttttaygygtttatggtttygggyggygygygggggttttyggggtygtagtttygygtygtttggygygygtyggygtttygtttggttttaggttygggtgtygygygtygygttttataggygtygggttyggttgttygtttttttyggtyggygygygtagttttttygyggagtagtyggttaggtagttttgttygttgtttygttttggttygattgataggygygagygtyggtagtagttttygygtttygtttttygttygtttttygyggtttagtttaattagyggyggttgagaggyggttattagggtgaygyggtatygygttttgygaggggyggagtygggggtygttaygygygtttttygyggtaaaatttaaaggtyggtagggyggttttttaatttttttttttaagtagggaygaggyggaatttgtttygygaggattgtaattttyggtatgttgygygtyggygtygggtggaggggtttygattgggggygtagggygt

SEQ ID NO: 11389 - DNA, 325 bp, Artificial Sequence
  Description of Artificial Sequence: Synthetic polynucleotide
ygttgtygtygttgttttttyggtttttttgttattattttttaygttttgtagttttgttttttgtttaygggttgttaagtygyggtttggtyggtggtggtagtggyggagttagataaagttttygtttttttygttttagagttttttaggygttttaagtggygggaaggtygttagttttttaggtttygygttttttgtttggygtgggggtggggagtygygtttggttttaggagttttttggtttttgttaatttttygtttttgtatattgygtttattgtttgagatgygtygagayggttttygttgaygt

SEQ ID NO: 11390 - DNA, 1242 bp, Artificial Sequence
  Description of Artificial Sequence: Synthetic polynucleotide
ygtttatagataaygttttttygtygttggygttggttygggatgyggtttygagatttttgtagtygygygttggtttaggggattttygtaggaygygggygggygtyggggtygggtygggtttgggtagagtgataggtttttagtygtgagttttataagtagatttatttataatatttyggataggagtttaggtygygtygttygygtygttygyggggattyggygtgaatttataygttttttttttatygtttygtygtttgttayggtttygagattyggttagttttttygggggtttttttygtygygtagtatttygttygtgagtagttttygtttgygtttttttttttttagggyggtygtttttattttyggtttttatttagyggggatttattagggygagggttgaagatttygygggaygtygygygtyggggatagygaygtatttatttttttagttatttgggaggttgtaggttygggtyggagttygaggtttaggggygygyggagtagttttggttaaggygtagggygyggggttgtatgggggtttagtttagygtgtatatygtgtattttttagygtagggtttygygttttttygtagttyggtaayggtygttattttagagtttygtttattaggagtttygtttagggtatygtttattygggtttygtttttatygyggttttygtygtggtttygttttygtttagagtttygtttttagygtatattgygttagtyggatttgttttgtagttgggttttttggaggtttttatttygyggttattgaagyggatgagtgtgaggttgattgggggtttggggatgggggatyggagattattaagaatatggttgtgttgggaaatttttttttagagtagagagggagggttttttttygtyggggtgttttttattttttagtttttttygygtgggttygtattttagttagaggggatayggyggttaggtttgygttgttgygtttgagtttaggtyggtagaggtygtagatttyggttttttagtyggtagggattygtaggtgygygtttttayggaygtttttyggggaagttygagttygttttttgtaggtygggaagtattygtttygagayggtygtattttygtagyggaagggygtttgtattatagttgtagtattagygygtgygaggyggggttagggtygg

SEQ ID NO: 11391 - DNA, 1460 bp, Artificial Sequence
  Description of Artificial Sequence: Synthetic polynucleotide
ygygtttttgttttttttygatttagtygtaaatttygagttttagyggtygttttttttttttttygttttttttgatttaaggttttaaaagataaaygtgttatttttygtttygtttttggattttggtttygatygaatgtagtggggatygagaagygtaaggtttaggatttgttagaggggygygttaagggygtttttgtttygttaggatattatygtttgggtattttattttattttttygtagttttttttggggtygggyggggyggggyggggtaggggggtygggygyggtttaygygttttttygagtgygyggtgygggaygggygyggttgaygygttttygtyggtgtttgtgttttttygtaggttaggagggtattttgygttgttattyggatttggygggtagygagttgtagyggggtaygtttayggtygagtygtagygggaatagagyggygtaggtttgaggagtttgggygyggaygagyggttgyggttggtygagtttaaygygtagtatygygygygtttyggtttttttttygtgttygtygygygttttagygatyggayggyggtgtygygygagttggygygtyggttgttttgttygttygygtaggagttgygtattgttttgggygaggtgaagaagatyggtagtttgygtttggtygatttttttygygtagatttygttaagttgtagttgtygygygggttagggattygggaygtataatyggaygygygggggttayggttyggagttgtgygttttgggygggaggyggattygggtttggaatagygtttatataygtgtataaaggaagtggagaattgaggtaattataygagtaatgagtttttttgttygtttatttataygygtaygygttgttaaaatatttatattgtttagtgttttgtttyggatttatttagtttattgttttaattttttattttttttgyggttttygatattatyggtttttgtggattttaaagygtttatttagttttttttaatttttttttgttaagttygaattgtaaagtaaaayggayggaaaaggaattttttatgttatagyggtttgtttgtttttttttttttttattttatttgttgygttygatttttatatgtgagyggaagyggtgttttygtttttgggtattaggggagtagattgggagttaggaaagttaaaygttggtttyggttyggtttggggagtyggggaagtygtaggaaggaggyggtgggtygggaagagttttgygaagggaagagttaatygaagggttgggaaggygtttygtggggayggayggaatagttgtagttatygtttttaaaaggygggaggygtttagttaaagatttttttyggaggtyggttttgggggggtggttygattgtttygg

SEQ ID NO: 11392 - DNA, 1064 bp, Artificial Sequence
  Description of Artificial Sequence: Synthetic polynucleotide
ygattggyggttgtgtggygatagygtaygtttagtttttggaaagttttgtagtttattaggagagttttyggggygtttttttttttggtttttttagggatttgygggtagtggaggagttttttatagygaggtagygygtttaagtyggataggatgtttaygyggtatttttttgtttygggttggaaggygaattttaggtttygygygtttagggtattgttggtttttagtagtttttttaygattagaggtaagtttygagttataatttttagttgggtgaagattatttttatttttagtattagtggtagtattattgttttttygggygygttatagygtagttgtagtyggaygyggtttygagaygggttgygygygtttaggtgagagtagygtatttygttagggttaaagtygtaygggaagygtttgggatttaggyggttyggtygttgggttagtgygtygttgtttagtatygaaatygygtagyggttttygggttgtatttgtaatattaggttatgtaggggatttagttagattttayggtygaaaggtattyggagttygyggttygttagtattatggtttttttagtagggatttttgtagttttygygagattaggggatagtaaygttttgtygaaggtagygggttgtgtygggaygyggtttattagtgataggagaagtagtagtagtagtagtagtyggggyggyggtggyggttttggttgaaagttggtggagttgtttgttyggygygaggataattygggagtttyggttgagtgtatggtttyggtgttygggtttggataggttagtttgagagtatgygaagtyggttttygggtagataataagagatatygtygggaagtgttaggaatttygygygttgttygyggggtttttttgtagtyggggttgggttagaaggatggtaaagttgygyggygtygttygggttggagtygtagtygaggagtygaagtttttttaggtygtttagtttygtygttagygttttaatygygygg

SEQ ID NO: 11393 - DNA, 622 bp, Artificial Sequence
  Description of Artificial Sequence: Synthetic polynucleotide
yggtttgttaygygttttygtyggggtttattygtatttgggtyggggttggtgtttaygygygayggttygggagtayggatttttgtttttygtagtatygtttttygggtggagtyggyggtttygtttygtagagttggggttgtatttggggtaayggggtygggtttggaygttaggtyggaggagtagtatttgttaggagtaygtttygtyggtaggtygtaggagttttgggagtygtygttatgggtaygttyggygggtggggggtyggtygggttaaagattyggagttaygyggggygggggtyggtatygagggtygggaggygygaagggtaygyggyggygggaagyggggygattygaaggtttaygggggtygggaggttgyggggygttygggattttttttygggtggttatygtgyggtyggggygyggaagttagaggtgtttagaggygtygatttygtygaggttgygattttggttygttygttygtggggtattgtaattttygtatttttattttgygggtygggagtgygtttggagygggaygggatttagygggtgayggtaggggyggtagaaatatygtttaattggygg

SEQ ID NO: 11394 - DNA, 1622 bp, Artificial Sequence
  Description of Artificial Sequence: Synthetic polynucleotide
yggttttatygggttgtaagggtygggaagttgtgtygggggygttttagaggttagagttagggagggggttygygatataggygggttttttaggygggtttagggttaggatagygyggtattattyggttagttttttgtagttaggatgaaggtyggggatagaygtttagttttagattttttagatagggttgggtagtgtyggtgggtgtttgggagaggyggaggygggygtatttttagtattaggttygggaaggatayggtgtttagtygttggagtttttggtttgygtgttttattttgattttttggtatttggtgaayggttttttygtagggtgggggtagttaggggatttgtygaggaaagttggggatagygggtttggtggygyggttyggygyggygygtgtttggggygygtggtyggttatagaattyggggagggtggaggttttygggtaygygtyggggtggtgggtagttygggayggtagyggygattygttatttgaggaggggyggggattttatygyggttaggtygaggygtygagggttttttgyggttttygttttttttygttggtttygaygtygygttygggtygggattygagtttyggtttygyggggtaggtttaggtttgygygttgygtttgtagtygaggtagaaattygtttygaggygygggygtygggttygggttttaaggatgygygtygggttttttttygyggggatagtygagtttygtyggygttttaggtgttttygtagtgygttygggygyggaygtttttttgttttyggaggggaagygggagggtttttggggtaaygtttygatttygggttttttaatttgggtygatagtyggttggtatagggaggtttgygygggagaggggyggagagagygtagygyggggtatagygggyggttttygtgtygygygygygattggaaayggygtgtagattttaaaaygagggttttatagagggttaygaggggtaggagagagttttyggagaattttagtttttygatayggttattttttggtaaaygagygagaattggggygtagagttttgggagggtygttttttyggygggagyggttygagtatagttttatagtagatgygagygyggygggygttttggtgaygaagtagygggatttgtaggaggtagaggtttggtggggtygtggaygttaygtygagttgtttagatttttttagaagatagtggggattatttaayggtttttagtagaaattaagttaggtgttygttttayggagattgttyggttgtagggtggaggttggatgagaataggygtttttttaggtaggygttygtggtggtaaygttgtttaggaggagggtaygggtttygggaagatttgygaggttaaatyggtagtttyggagaattgagygtaagaggtyggtgatatagagaggagttygggaggtygtatgttttaggttgaagttatttggyggggaygtttattgagatgygaaatataggaagggatagaggttgygtagagggaaaaggygatggattyggttttggaaaygt

SEQ ID NO: 11395 - DNA, 324 bp, Artificial Sequence
  Description of Artificial Sequence: Synthetic polynucleotide
ygatttttygagggaggagatagygtygtttttttatttgtataggtgttttygtygtaggtttygtatatttatttatggtatttatataggggttygaagaatatgttyggtttagttaygtggtagatgtagaygtygtagtygtagyggtttyggtygtggtatagygyggttttygggggttgtttaggtgygyggtagygtygtttygattyggttygggatagtttgtaggyggygttyggttagtttttgygygggygataagtaatyggtaggtygggttagaygyggaygtygttttttgtttygaatttaygt

SEQ ID NO: 11396 - DNA, 1881 bp, Artificial Sequence
  Description of Artificial Sequence: Synthetic polynucleotide
ygtattyggtttygaagaaggygtttttyggataaaatygaggaatttgttttgttttgtaaggaattagggtttgttgatttttagattttaaygagaatttttgtttttygtaggygttttataaatttttattggataattttatygygygttattgggttttygggagattygtgatttttattygttttgggygygggttygtagagttttaattygygttttyggtagtygggatttttygttyggatyggtttttaggttggaaatattatggttygtattyggggygtagtygagatttatygygtyggaggtttygggattygtttagatygttgtttggttattttaygtttttgagttttttatatagttagtttygtgattttygagtttygtgattttygagtttygtgatttttaagtttyggaagtygttgtaggtagyggtttagttaggtttygttttttttatyggagttttaygygttaattttagttaggtttygttttyggtygttttaggygtggatttaagttaggtttygttttttgtttggttattttaggygtttatygttttaggygttttttagtttaagtttaatgttyggttgttttagaygtygatagttttatgtttygttttttaatyggttgttgttggygttttttggtttaggtttygttttttattyggttgttttaggtattttttaggttagatttygttatttatyggtygttttaggygttygtagttttaagtttygtttttygttyggttgttttaggyggttttyggtttaagtttygttttttgttyggyggttttagaggttygyggttttaggtttygatttttgttyggttgtataaggygttttttgggttaggtttygtttttagttyggtygttttaggtttygtttygttttttttgtgygygtttygttyggtagtttgtgggaygygatygyggygttagtttygtttttttgtgttgyggyggyggtttttygagtttttttygaygygttttttaggttagygagtttygygtttttyggtgayggattatgtyggyggygggagygggygygggygtagaggygggtttttttagygaggagttgttttygtttygtttttygttgtatygygtttgtygygayggggatttggttaygttttgttygttgttgtagtagatattttaygtttatttggtttttgaggattttttttatggttggaygttygtgtattgggtygygtatttyggtaaggtgggtgygaaygttttaaggygttatttttttyggttgtttagtgggagtyggggaaagygggtttgaggtgygggggaygtggggygtgtygggatygyggggyggaagygggatygayggygtttgtgtttygaggggtttagggygtttgtgyggtagygttygyggttyggagtygyggyggggtagtyggggggygyggggyggaagygaggtyggtggygtttgygttyggaggggtttagggygtatgtgyggyggygygygtagtaagtttttaataaggygggttttaagggtttyggygtttgttggtyggattttgtgygagygygygygygygyggatggtgyggggttttttaggtygggtyggaggygygagygatttygtagagtygggtattaggtygygaagtygtttaggyggttttyggggagtygagttggggttagaggygygyggggaatgttygggygyggtygattttttggtttygtatagtttygttagtagtygagggtygygttgyggaygagtttagtygaggagtaagygtttyggygggattggaaggtttygg

SEQ ID NO: 11397 - DNA, 944 bp, Artificial Sequence
  Description of Artificial Sequence: Synthetic polynucleotide
ygtttatagggygtygyggyggygttgtagagtttatagtagttygtgtygtygtttygttygttagygttttagygaggaagtagygygtagttygyggtttagygtattygtagtagygttygtagttygttygygttatgttttaggyggtygagygtttttaggagtgggttatggagggttttygygaygggttgaagaaggagyggttattggaygatygttaygatagyggtttggattttatgaaagaygaggagtaygagtagatggttaaggagttgtaggagattygtttygagtygtaggaggtgtygygyggttyggagttttggaagtagtagtttatygaggayggggattygtaagtggyggaggttyggggttgggggtygtygggagggygggaygygygyggtttgggggtgggaggygtygggtttggagttygagtygggggattagygatgtagtygggygggygtygyggtatttyggggtttttgtatygtttygaaygttgtagggttgtagggtygygyggggtatyggtttaattyggaggggyggyggttgggttttggtggatggtagygtygttataygttttttttttttagattygttttttaggtygggggyggggyggtagyggggaygygaagttttyggttgtataaggyggggygggagtttttggtygttggygggygtygagtagtygggaggggaagtatagggygtttygagttggygggagggyggggyggtttggtyggygttygtyggggtygyggggggaggggggyggaaagtttttgggygtttgttaggaatatttagtttataataatttygyggaaaatatygyggtttyggtttttagaaatttyggttttgygtaatttttygtagttygygtttttttgggttttaygygg

SEQ ID NO: 11398 - DNA, 1514 bp, Artificial Sequence
  Description of Artificial Sequence: Synthetic polynucleotide
yggagtygaattyggtgtttttgttygtttggggtttygttagygygtygtaagtttttttagaaatttaaattttgtaggtygtatttttaattygtattttatttaggttttygtttggygtygatttgttttagtttaattttyggtttygtagattaggtatttttygggaygyggggtagattttgygttygggttttttttygtagtygggttgttyggtttttgygygygtataataggyggtayggygtagttttygggagygygggattygggtgttagtttyggygtttagttatagygatatagatttgggtgtyggggttygttagggagttttgtgattyggggattttygygatgtagagaattagggatygygtayggagtttaggygygtagtttgtagttaggattagtttttygttttygtygttgaagtygtttygagttttaygtttttttygttgtygggttyggttgttttagggtttygttygttygttttagagtgagygattttygatttayggagaagygattttattatyggtgttygatatttagagttaagggagygagaagaaggygaagaaagaggyggagagyggtgtattgttttygttgggattygygatttttagaaattttttygaaatttagtttygtygtygtttygtyggtagggggtatagygggygttyggggygyggyggttgagygatggggygagyggaaagggtttagaygtttggtttttgtttatatttyggagaaagttttgagtattaggygttgggttttttggttatttttttgattttttttatyggygtygagtttgttttattttttttagttttttggtttygttagttagaggggygtttygygttygtttygttttttatttaygtttttygattygattygttttttygaattttygttttttgagatttygttttygattygttttaattggtygyggyggtagtygagtygygggagttgygygttgagttygyggtagtayggggagygttygttygtttygttttggatttaattaagygtttygyggaggggtgyggttatttgggggtaggagaaagyggagtaygttatttttttagggatttaggaagygaggygagttttaggtggaygyggtggtgtggattayggygattagggtttttttttttgttgtggagayggaggtgygaggggaygtyggyggttttttattttttggtygagtggtttttttygttttyggttggattttttyggggygttttttttagagtygagtygggttggtygggggyggttgtttggtttgagtgtygttttattaaagyggaaygtyggaggggaggttatttygagagaaggyggttttyggyggaggtggtttygtgaattttgtagttttttgttygttygttattygagaygtygygtttygtgggttttaygttggatggagggggygtygtyga

SEQ ID NO: 11399 - DNA, 2144 bp, Artificial Sequence
  Description of Artificial Sequence: Synthetic polynucleotide
ygygtttggatgygtttttyggattyggttttatataagttttagtttttyggattttgtatttttttygyggatttttttatttttttatttttaggtttagatttttttttgtyggaatygttaygtttttttatttttttattttygttttattyggtttttttttttttggtttttattyggttaggttgtttygttttggtagttttygagggtygttygaggttttygtttattaatygttttygtttggaagaatgygttygttygagygtattttyggygggtgttaaagtttttygttttaataggtgtttttgtttggttaygtatagttttgttatttggggttyggayggagayggygataggatygttttttgtagggyggttgyggtttygtaygttttygttygggtttttagagygttaagggttttygtagtttygtygtygttttygttgtgttatattgtttttgtttttttgttygtttagatgtygygaggttgattttatgtaagggtatygttaagttygggygttgatattgtttatttattygtggtggyggattttaaggttgggagtgagagaygygtatagtgygagatttttttttaatttagagaatttyggggaagttgggtgttygygtygaagaagygggtttaagttgattyggtttagaagggggttygaagttaggygtagygtttagagagtttttttttatttaygtttttattygatgttttttgtttttagaaggttggagaggggttgygtattgttatttaygygttyggttgygagtggtttttatygttygttygtygygygttgggttyggtagtttttyggggtataygaggttttygtagtttttagattttyggtttyggtagygtagagtygggagagtygttaygtttttagtygygygygtaygtygggtttattaaatttgtagtatttttttttagtttttattttttgttatttttttttagtyggtgygttttagtttygtygttyggtagaggttgttataataaygggtaggaatgttttaatatatataaagtyggttyggygtagygggtatttagttttggtygggtttygygttttyggtygtygygtagggtttggaygygygtygyggttttttagtyggtyggtygaygttyggggygtatttataatgagygggatggtgyggttttygyggagttgtttygattttttgtttgttttttgygygtttyggtygtyggaggatgttgygtgggttyggttgttttgttataagtagtagaaagtgtttaggatttaggttayggttaggatggygatggtattggygyggattttttttatggtgggtagaygggygttttaggtgggggattgggtyggygtgttttyggggtyggggygggggygttygtagttttagttgtttgttttygttygygtttagttgtttagttttgtagagtagaaaaaggagagaggtgggggggygggggggtgatagggagagataggatygyggagygatttttayggttttaatgttttttagtttygagygygygygtttttygggygtttatttattygtgygtagggtyggtttygygttttagtygtygtyggttgatttattaggttattgygtattgggagagaagygygtygagtgggaagyggygygggtttttttttygygttygggaattyggygagatagaygttygyggyggaatggygattggttaaagttagtttyggtttttatygttaggtgatygaaygttyggtagttgttttygygyggttttggtyggttttgtygatttatatttattttyggatygagyggttttgagttatygattggagaygygygattttygatttgggttygygtygygagttgtagtttygggttgygttttggygygggatttaaggtgtgttyggygagtttttgtgtaggggyggttgggygggggagagttttgagtttgtattggaatttgtagttgagattagttagatygggttygtttagaggagggattggaagttggtgtatttgatattygaagagygygaaggggaaaygaygt

SEQ ID NO: 11400 - DNA, 379 bp, Artificial Sequence
  Description of Artificial Sequence: Synthetic polynucleotide
yggtgygggttygtttttttttagtttagtttttttgatatygttttttttttggggaygttgtttgygggttygygygttttygttttygatttttttgtaggttttttygggggtyggggtaggatygtatttatygaggattygggygttggagttagtagtagyggtaygagtaggagtagtygtattttagtttgygggagaygtattgggttagagyggttyggggttttygtagttgttttgggygygggygagagtgtgtgggygygtttttttttatggtttataggtgattaggagattygtaataggatagtygggtgygtttyggtgtatygtagagaatatagygtgagggygtttygtygggygg

SEQ ID NO: 11401 - DNA, 637 bp, Artificial Sequence
  Description of Artificial Sequence: Synthetic polynucleotide
ygtygttttatttttaataagtygaagtttttgaaggaggttyggtgttatttyggtgtgatygygtttyggygaygttgggtagggtgtagggagttagttyggtygyggtttagygggaggggagggggtyggtttygaattygggygttygggtygygggtgatttattgggaaygttaggttygygygtttagatyggygggygaygtttagygygttttaygtttttygttygggtygttygygtagaagtagttttygygtatttttgtttttygagayggattygtygggaaggagtttggagtygggyggtyggygggtagtaatttttttttttttagttattatggtyggtgygattttttattygygttygtagayggattttttggaaagtatygggttgggtttatttgattggygttygtaggggtygtygatttttttatagatttayggaaattgtyggtygtaagtygaggttyggtttttagtattygtyggttygttygygtyggttttttaaagagttgttagatttattygttagtagtttttttattygatygttttgtaggtgyggtgggtttttttttygttttygaygygygtgygtattttygtgtygygg

SEQ ID NO: 11402 - DNA, 959 bp, Artificial Sequence
  Description of Artificial Sequence: Synthetic polynucleotide
ygggagtggggygggtaggaaygagggtttgagtttaggatygtaattttygtgaggggttygaggattttagtttaaygtttygtygggtttygtttttatttttttttttatggygagttygtygaggtttygtygtttygttattygtttttagygtygygygggttttgttatygygtttaygttyggttaggyggygatttttygygttttgtttygtyggttgtygggggtttaagaaatttygggggggyggggtygggggyggggtgaggttttygggggtyggggyggggtyggggagggggyggtggggtygggggttyggtttagggygggaaatgggtggggaggggyggggtttgggttggagattggayggaggagtygggyggagatgtaattggaggaagagggygggayggggyggagaaggtttttygtatyggyggagggagagggattaggagggggttgyggygggggaggagagggggttttyggtttagagattgaggygagggtggygggagyggygygtaggtagggttggggtggggygtatatagtgagygttgggggygttggyggtggagtttttgaggtttttygaattagtgggttggggttgygagatygagtygagttgttttgggyggttagagatgtgggtatatagaggttttttttttttttttttygaygtygggtagtgggyggtggtttggttttttttttggaatttttgggyggggtygggtttggagtttgggtttttgttyggagggtggtgttataggaagagttggagttgagagtygggatttyggggtttttttagggggyggttygtttttggtttttaggggtttttaagygtagtgtttttttgttttttttgggtatygtttaatttttttygtatttgagggtygattattttttygatttygygg

SEQ ID NO: 11403 - DNA, 826 bp, Artificial Sequence
  Description of Artificial Sequence: Synthetic polynucleotide
ygtttatttttgyggygtygtgaaagaaggygtaggaggagggagttttgatattttttttygggttggggttttatagyggygaaaagayggagggagtgatygggggtygyggggattttttygggaygggttttygtyggaggagtttyggaaagtygttttttattttygaggtttygtttgygygggygttttattagyggtyggggtggtggyggyggyggyggyggyggyggyggygyggggyggggygtygygatttttgttttttttttgggtygagyggtaggygygttygtatygttttygttttttygtygtagtygttgtygatyggttggttgggttttgyggygtgaggatttyggyggygtygtagtttygygagttatggtttagttyggyggggaggttyggttygggtttaagayggyggtgtagattygygtygttatttaggaggtygaggaygtggaygagttggaggaygaggaggagggggyggagattyggggygtyggggattyggttyggtattttagtttyggttggggtagygygagygaggaggagtygagtygygggtataggtaggygyggyggttggttygggaggtgggtttygagggggygtygggtygygygygagttyggggygttgattgygygygataatttttygggtagagggggttgagttagtttygtygtyggggaagtagtttygggtygagtttttgagttagaatyggttygtggaggtagtyggtgttttagttygtagtttygtygtttaatygaggtttttagggttggyggtygg

SEQ ID NO: 11404 - DNA, 2156 bp, Artificial Sequence
  Description of Artificial Sequence: Synthetic polynucleotide
ygttygaggaatyggtttaatygtttttygttgtagtyggtttgtttttttttyggaattatygagggagaggygygtgyggaggtyggygttyggatttygtattygttattgttgtyggygtattttttygaagttttatttygaagggttgggttttattygygygttttgtgygtgtttttttgtttttttaygttttttttgtttggttgttgygaggttttgtaggggaaagattggygyggggttygtattttgtttatgttataggaaaatygtgggagttttttygaygyggygtattttyggaagttttttttttaggagggttgygggaaggtygggattttgtatttagaygaattyggtygttttttaagaggaaagtyggagatttagttgaggggtaaaaatgttagggaaaggygagtttagagtttggtgatggagaaattgggaagttattttttattttttaattttaggatggggaattygtaattgaagtyggagttttagatttggggygtatttttagtttagtttaggaaagagatttaagggygtagtagtgtggatattttttatttyggtttygaaggtttagygagggtttaatttgggttttttgttaggttygtttttygtttttttttagttttyggttygtgygtygttgtttttttaagaagtttaggtaggtaggttyggttgttggagtygtttttatggtaattygygagttgyggyggttttatgaatatttyggggygygggagttygagygttgtyggagggygtttygggggaggyggtygttgatgtaagttyggygggtygttgggtttygttyggttgyggygggagtttygggaygggtyggaygggtyggggtagaggaggygaggygagttygygggtggttagttataaagttygggyggygagatagayggatagttagttttttygygggaygtaygttygggattygygygggtygtgygttttgtatttyggagyggttttttgagygtygyggtygtagagttttttyggtyggygtttattgtttttygygggggyggggygtttggagtygggyggygygtygygtttttgaaygttagagggagggagggaggtaagaagggagygyggggttttygygtttagtygggttygggaggaggtgtagygyggygagttyggggattyggagygggattaggatttttttygyggygygtagtttgtttaagtatgggygtttgaggttgtttttaygtyggyggtaaaggaygygtttttaygggyggattgatyggygggyggatttggagttygttygyggygtygygtttttgttttyggttyggttygatttyggtttttggygttatggataagttgtygtygtttatgygtaagyggttttatagtttttygtagtaggtgggggttaaggygtggattatggaygaggaagaggaygtygaggaggagggggtygggggtygttaagattttagtygtaggagtattyggttgyggttattgttttygttttttttttyggyggtygygggtggtayggagtttyggagttyggttttyggggtagyggatagygaagggtyggttygyggygygggtaagtttagtaygaayggygattgtaggygttttygygggagtttggtttygttgggtagtyggggyggyggtagyggyggtayggggagyggtagtagttayggatatttgtatgatttygyggaggagyggyggtttatygtygagggygaygygtttttyggygaggataggaygtttttaggtttggyggtygagttygagygtttyggygtttyggygtagttygtagtttygtygtygtygttttagtagttatygtagtyggttttygttttttgygagtagttttyggtggatatygttattaaagtggagggaggygyggttgtyggygattagattttttyggaggtygaggtgygtttgggttaggtyggttttatgtagygttagttyggggttatgttttaattyggggttaataaattttttttaaggatgttyggtagttagaaagtygtggagygygaataggagagggttaagtyggtygg

SEQ ID NO: 11405 - DNA, 1441 bp, Artificial Sequence
  Description of Artificial Sequence: Synthetic polynucleotide
ygtaaggaggaaaaygtggaatygaatatagtagttgygggatygtattaygtgatttttttttygyggtygttttatagaatttgtgggaaggggggggagggggagtgtygtygtaatttygaggataggttagtagttygygggttygattttagtyggygttttyggggttattatattttttygtyggyggggaaattatattttttataygttygaagtygtygttttttygatayggttygttyggtygtaygtataygttaygggtyggygtttttyggtataygygygaaggtygggtttygtttygttttttatygatttygyggagyggygattatyggttttaattagtttyggatttygggygygttygggtyggtttttttttyggtttagttttygttaatygggggatttatttygttgaattygtttattygggagggygygttttygttttattgttttatattygagggtaatagyggtygtatygtttatttgggtyggggggtttttttttygttttyggtygattgagtygggttggggttttygaggaagygygggtygtygggyggttggaagtgggggaaggagaggagggggagggggtygggatatygggagtygttttttttttttttygtygattgyggttttygtaggttggtygggygttttygtatattygtttagttttttatagtttygygtttygttagttttttttttattttatttttatatatttttatttttatatatttatattyggtygtttttygtttttttattygtttgtygygygygygygygatttygtttatatatagygygygygaygtyggyggagatygtttygtttttttagatygaaygtygttygttygtttgttgaggagyggygygygtttyggtttygtttttttggygtygyggygyggygggyggggggyggyggtyggaggagttgggggtygggttagygygtygagtattgtygagyggatttgatatttgygtygagagtygtttttttagtttttygttygtattygagttatygttggtttygggggaagagaggygatggatygygygyggggagygaaaagggagygygagggygtttygaggaygygtttttttattygtttttaaatygtttttattgagaaagggaaayggatggggggggtggggggygaggtttgtttttaattygaaatygygagattagtttttttygttgtaygtttttttygtttttatattttttgtttaggttttattaatttgygtttggaatttygataygagttttttattttttygggygtagggttttgtyggtatttygaygtttttygtttagttttttygtyggtygtygttyggagttttygtttayggtggttttttttttygg

SEQ ID NO: 11406 - DNA, 734 bp, Artificial Sequence
  Description of Artificial Sequence: Synthetic polynucleotide
ygggtttygttygttttgtttgygggtygatttygygaygtygatyggttygygttttygttttygagygtttyggygggyggagttgygggtgaggggggggttggtttggggggygggggtttygatgayggtatyggagygygtygtattggggatggaaatttgattgtttggttygggayggygtttgtagttaggtaggtgagtgtgggtyggagagygggttaggggygaggatygggtgggtggagggaggygygygtttttttttygygtaggtttgggtttagtggttttgggagtyggtatttttgggagatttgattyggtatgaggagttyggtatttttgttttttagttttttggaagtttttttttggattggtyggygtygttttttygatatttgggggttgaggtyggtatttygggtttgygtggaggggygagygttaaggttgygagagtygggtttygatttgtaattattttttttaatttttatggagtttygtttygygttygtygtttttagttttagttgttttgtttyggtttygaatagygtttgyggggttgttagagtattttyggagygggagygttgtgyggagagtaggggygygyggaagtygggattgtatygggttyggaaygtttaygyggaggggtgygygaaggtttatayggtattgygaggtagagtttatygttgtgtgtttagggtygg

SEQ ID NO: 11407 - DNA, 935 bp, Artificial Sequence
  Description of Artificial Sequence: Synthetic polynucleotide
yggyggtgtttagggggagagggttttagygtygtygttttttaagtygattygttygtatttggttttttttttatagggttggagtttggatgaagttttttatttttgttagattttagtyggggggtyggygtygygaggtttttatgygygtttttaaagttgtygygggggaggggttatttttygttyggggttgagattagtygagtttttygtttttgttyggttygtttatttygggygtatagygttagtyggagtagttttagtagttgygtttttagttygtaygygtttaggtttagtatggyggygygyggttygggygtygyggagtygtygaggagtygtygttygtttygtygtygtttygttyggygtttagtttyggygygattgyggtgagtttatttyggtygggagygtttttygygtttagtygygttyggtagagagtttttagtygtttyggatttygygtagtttygtagagaygygygtgtygttygtaygggtyggtattygggtygttttygtyggygtgttaggatttygtatagaagygttyggaygyggaygtaygtagtygyggttaygattttygtygttygttyggttygtgttyggttttggttagtagggttgttttatttttayggygyggygggagttygagggggttttttgggaaattttttgyggggygtygtggygtaggtgygtttttatttttagggttttattattygyggttatatttggggtyggatygygygttttttttttttttttygtttttgagggagtttttgtttgggtygagggggatttygggggtttgtttagttttggggtgaggggttggtttaatattttataggtttayggttattagtagggygggattatagtgggygygggtygtaygt

SEQ ID NO: 11408 - DNA, 1054 bp, Artificial Sequence
  Description of Artificial Sequence: Synthetic polynucleotide
yggggtgggggatattygggttgagttagttaagtygggagtgtgaggagtagygggggtyggtaggaaygtggaygygagattggggagtagtggggttgtttgtgyggggatgtagtttttattaagtataygggtygagggttgattataggtagagtagygttttttggtagygttgygggtgtggatgagggaagttaggtttyggatttatatttagayggtygttttttagtttgtttttttttttttgtgggtttttaaagtgyggtttggtttttttatttygattttgaggtttggaggtggggaygggattgtgggygtyggtaaaygtgagttttygagyggggygggaaaggagtttygygaatgttttttttagtttyggygttttaygtgtaggtttatgattgggagygtttttaatttaaatyggtattgygtygggattattttttttttggygtygttttygtygtttttttyggatttttttyggttttttttttatttttygttttyggggtttttttttgttgagygggggttgtygggatttgggattgyggggttgtttygatttygtagtygttygyggtggaagttagttygggtttggttttgagygygyggttggggyggtygttgtttatggtgttggygygggtggygygtyggtyggyggggtttgyggaggtttaggygtttttggyggggaaggyggygttttygggtttggggagygagggttttygttttaggggtayggaggatatttagattggggygttygtgggtttggtgttgtygtttygggygtyggtattttgygatatttttttttttyggttttgggagggaatygaggtagtttygygttaggttttttyggatatttggggtaaattygttttttagagtttygtgttttttttttaaatttgaggtagygatttttttatttttaagggyggtygtgaggtygaattatgtgtygattttagtyggtttttgtaaaygttgtgatgtyggttttyggaggtygygt

SEQ ID NO: 11409 - DNA, 1474 bp, Artificial Sequence
  Description of Artificial Sequence: Synthetic polynucleotide
ygttagygtygatgttgttgttttttygttttttttatttttatatatttttattygggttttygygggtttttygaattaagtttttagtttagtttttttaaatagtttatatagygataygggtattgggtaattgtaattagttttaatyggaagtatttgtttgtgggtgagatttatttgattttyggggtyggtygttataagggygagggttgaggatttttygtgggggatatgggttttttattagtyggaaagttttagygatyggttgggygtttttgggtyggattygygtygtygttygygtattggggttttygaggtgtgatgttatttgttygtagaatyggtttttttygygtygtttttttygygtttttattttagtttttttttygtygttttyggggttaatatggtagyggygtygtygttttattttygtaatygtaygattyggttggtagggtygtyggttyggattttygagatttatatttyggttaggttygtaygttttgygtttyggattttyggyggtttttygtagttttyggggygtygattttygttygttgttataygaggttygggygttttygatagttygggattaygttagagtgaygttatatatyggatttyggygagttgygggtatgagtaaygygygygttttygttttygagtttttttygtygtygygtttatygttgaagattatggyggtygaggygtttatgayggygaaaaaygaagtatattyggggtygtttttggattyggatatgtttgygggtggggagggggtaagttttgtgggtygaggyggtggyggaggygggggygaggaygggtygggtaygaaggtttgygggygggyggyggygaaggygattyggttygttagtygttgygttttaaatattagtatygtagaataaaatggyggtygyggtygygttatatgatttgggtttygtttttgygagtygtattatttygtatygtgggggagaygygttttygggaygttyggtyggttygttgatttttttygggttgtgtygttygtttagygattyggtttyggygttyggtttygttttgtttyggttttygygggtgttttygggygtygtyggtttttggattttygtagygttggatyggtttygygtyggggyggggyggtgtggtgtgtgttttattagtatayggggyggggtttyggaygtttygttttttttgyggttgygygtygtttgtaggtgttgggttttyggygaygtttttttttgtatttttggygtgaagttgtaggtygtggtttygyggttttgtttttaagayggggttttattttttygggygttggttttttaggatttttttattaattttgggygagttaagggttttagtagatgtgyggygygygggttttttttgttatagygttygg

SEQ ID NO: 11410 - DNA, 357 bp, Artificial Sequence
  Description of Artificial Sequence: Synthetic polynucleotide
ygggagatttygagattttyggtyggtgatagtaggygattttttgtttttgttaatttgtgggtttttayggaygtggggaagggaggagggaggttttagttttttgygggggaggggygtgaagaygygygggggtggggggagatgagtyggygtygttatgataaygaggtyggtggttyggttttggggattygggagggagggaggygtygtggtygygygygygggygggggyggggggttaggttttttaggagtagttggggaatattyggygattttggyggttgttttttggtggygtagggagttygygtgtttgygagtgygtgtgtgtgygaagtttttygg

SEQ ID NO: 11411 - DNA, 814 bp, Artificial Sequence
  Description of Artificial Sequence: Synthetic polynucleotide
ygtygtttaagagtttggggtygtggggggyggggttgtttgttatyggtttygtttygtygataggattygtttttttttttaggttyggyggggtygatttygtttttygtttttagtttgtygtaygatagyggyggygyggygggyggagtygggaggyggggaagtagtggtygtgtgagygtgaggagttgtygttatygtttgtttttygtttttttygtttttyggggttttagygtygtgggtygygtayggttttggaagagaygtygtttygtttttattygttttttttatygygtygttttttygttttgttttgygggtttaggyggaattyggaayggtygtttttttttttygtttttygtygtygttttttttttttttttttyggttttttttttagtttygggtyggagyggggtgtyggyggyggtyggttygggyggyggygtttggttatgtygtgtyggggaaggtaatgagtygtagagtttyggggtttyggttgagtagyggyggtattaattattygyggagttggaatgattggtaatttaggtgggtgatyggttygggatttygtttygatttttygggtttygtttygggygggtygaggtttagggtygyggggttgggaggygyggtttaggttttttatttatyggagtygggygyggttttttgggttttttttttttyggttaggggaggaaggtygyggggaggygaggtttaagtgttttttttttttttgtttgtttagttyggggttgaagtygagtttyggggttttyggygg

SEQ ID NO: 11412 - DNA, 847 bp, Artificial Sequence
  Description of Artificial Sequence: Synthetic polynucleotide
ygtggtgagatatygatttygtagagtagagggggyggyggtagaggggaagggttttygtatttattttttttgtaggaggtgtatttgtatttttygtatttgtaggagttygygtaggtgtaggagttatttagagagggygaygttataggaagggttaatgtggaygaattygggtttttaygtttgttaygaggagatggggtgttaagtttttttgtttttygygatataggtatgttygttttttaygaggtgaagaatagggaattaggggttttttttttaagtgtttttgagygaaggygtagggygtgggtttttttgtaggtataagggygygtagtgygtaggatgygagygggggygggggtttattagaagggtaggggtaggttttagggtttatgtygaggagagtagtagttggaggyggtgaaygggtttttttaagtaattggaygygyggtttggttagtggtagtaggtggygatgtttttatagtttygggygggggygygtatgttaagttygttgggygttygtttttgygtatygygttygtttttttygtttgtgygtttgggtttyggygtaygtattgtatttgtygttygtttttgtygtgtgtgtgtattgtyggggttygttygtttaygttygygygtgygtttttatttttatttygtattygygtgtaygatttattygtygtygttgtgygygtattgttagtttatttttygygtgggtttygtaggggaygtgttygtygtagtagtygttattgygtggaagygygtaygtattattttygaaagtggagaaaaaggygttttgygt

SEQ ID NO: 11413 - DNA, 589 bp, Artificial Sequence
  Description of Artificial Sequence: Synthetic polynucleotide
ygtgggtgtttyggaggaaayggtygtagttttaaattttttagtttttttagtagggagttttttygyggagtttygtttggyggtyggaagttattttaagtygtttattyggaagtygtygttttggtaattgggtatygttttattttttttttttagtaaygtttatygttttagaygtttgaggttagtygagtttygattggtttttttgttttttattttgggagaygtttgagatttagygtttttagatttygtatttgaatttgtggygtttggtgttygygagttgtygaatgaagttgagygttttagtggaattagggattttaggggtgagygatygygaggggagagygaygaaaagggyggtyggagttggaggggygyggagttaaataaaaaagggyggtyggagttgtaggggygtygagttaaataygttatttttagatggggggttttaggygagttgtttagtttttttgaggtaggtttttygtttgttygttttttygtagtttttgagttttttttttaygtygtttttyggtagttttagagaygttaygtttgttttygt

SEQ ID NO: 11414 - DNA, 848 bp, Artificial Sequence
  Description of Artificial Sequence: Synthetic polynucleotide
cgcggcgtattttttttttcgtattatatatatatatatatacgatgatatatatttttgtgtttttttcgatgtaagtggtttcgtttttcgttgggttttaggtgtttttgtaggaaatgcggaggcgcggggagtttagggaacgggtttggggttttaagttcgtgatttttatttttatttcgggttttagttttgcggcgtcggttcgtagcggatttatcggacgatgtcgaatatgataagtacgttgtttagtagttttacggcgtatacggtcgagtagagcgcggtgatggcgattgttagggcgagggacgaggcgtttcgcgcgtttggcggtttcgacgtattggcgttagcgttggggtaggcgttagggtaggcgttcgaggcgttggcgaagagcgggggttgtagttcggcgtcggcggagggggtcggttttatggttgtcggtcggtttcgtcgcgtttttttttatcgtgcgttttgggcgcggggattcgacgcgaggggagcggtaaggtagaggtcgcggtttcgacgtcgtcggttgtcgcgtttcggtcgtttcgttgtttttgcgtttcgttcgtttgtttcgtcgttcgtatcggtttagttttcggcgttcgttcgtttttttcgttcggagcgttgtgagttaggagtagtcgtaggtttttcggacgcgttcgtcgcgcgtattacgtggttcggaggcggtcgttagtttgcgttcgcgatcgggggcggacgttgtattatcggttcggagttgggtaggggaggtttttcgttttttttttagggatgtttcgtcggttcgagtgcgatttcgt

SEQ ID NO: 11415 - DNA, 1230 bp, Artificial Sequence
  Description of Artificial Sequence: Synthetic polynucleotide
cgcggttcgtattttttttgtttcgcgggcgttttgcgattttttttattgcgttcggtttcgatagaagtttagggagtagtggttttcgcgtttcgtacgttagacgtggggttaggcggtaggtttttagtttaggaatcggggagttttttcggaagggtgtgttattcggagttagcggttttttacgtatttttttagagtgagaacgtacgcggcgtagttatcggttcgttttttttatcgggggttttcggatttttaatttgtttggggttgtttttgtttttcgggcgaggggtttttggggatttaggatatttggttacggggaggcggggtatggggggtagaaagttagatggagcgggtaggagaaggggggtgttgggaggagttaaggagggagagagggggcgtgtatggggcgcggagttaagagttatcgagtttgggcgcggtgtgtaggcgagggttacggttttcgtagtagcggggaacgcggggagtcgaggtatttagcgggtcggggaagaaggtgggggatttcgcggacgtcgaggagagggtattgcggagttagtaggttttgtagggagtcggagaggggttgagtagattttgaaggcgggcgggggacgtatttttcggcggggtagggtgttttcggatacggcgagcgcgcggtatagttcggtagggtgatagttttttagcgtcgcgtatagttcgttcgttgggggtttaggggtggcggttgcggtagggggtttcggggtcgggatcggagcggcgggcgcgattttcgagtcgggagttcgggcggcggggttcggggtggtcgtcgttttttttttttgttgtagttttttgagtcggcggagggttatggtttcggcgtcggacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgt

SEQ ID NO: 11416 - DNA, 1094 bp, Artificial Sequence
  Description of Artificial Sequence: Synthetic polynucleotide
cgcgggagtttttcgagttttattggttttttttttcggtcgtcgttacgcggggcgtcgcgtttttacgggtttagacgtttagttaatttttcggttttgtaaaagtttttgggggtgcgcggggttgggcgggggtgcggcgtggttttttttagggtgggttttaaagtttttattttcgttcggggcgttgatatcgtcgattcgtaagtttatgtcgcgttcggagcgtcgcggggttagtacgttcgggcgggcggttcggaggaggcggcggtacggttggggtattttcggtttcgattcgcgatgaatggggcggttcgggtttcgtttttcgtagtttcgttcggaggtttcgtttttcgagtttttcgtttcgcggttttcgttagtacgttgttcgggcgttttttaaattgtttacggagtcggatttcgcgttgttaacgtttcgtttcgggtaaggttgcggttttcgtcgggtttcggcgttcgttgtttcgtacgttcgggttcgggaggaggaggtcgggggagtcgggtcgggcgtcgcgagcgttgggagggttcggtttcgtcggggagcggttttcgagggcgtaggagcgggagtcgggtcggagattttcgcgtagttcggtgatattttcgtttcgcgttttagttcggggtttttaggtatcgcgcgcgtttaggcggcgtattcgtatttattttcgtttcgaggttcgtttcgttcgttacgtcggtcgtcgttaacgagttttcggttcgcgtcgttttagcgttttgtagcggaggcgtcgtttttatttcgatcgtaggttcgttcgggtcgttcgttcgtcgggtatcgagtcgttttgtcgcgcgttgcgtttcggggcggggtgggaggagagggagtagtcgttattttgtttaggtcgtcgcgggttagttttgtagttagttttagttttgggtcgggtgttgggaaggtcggacgtcggtcggcggtcgcggggtttgtttttcggaggttggggcggtttaggttatagatttcgtcgttttcgtattttttttttagttatttttagcgtcgt

SEQ ID NO: 11417 - DNA, 1979 bp, Artificial Sequence
  Description of Artificial Sequence: Synthetic polynucleotide
cgtttatttttttcgcgtgttggagaattaattagtaaggtagggaatgcggttcgtgggcgtttggtttttttaagcggtttaggtttttagagcgcgaggtttaggggttttggagtcgcggtcgcgacgcgttcgagggtcgtttttttcgacggtagagtaagagttatcgcgcgggagtttcgagcgatcgtttcgttgtttcggtatttttttttcgtagtcgtttagagttttttatgtttcgtgacgttcgttagggtagcgcggtcggaggtcgggtcggacgtggttcgagatgttcgggggtaggtagaagattacgggtacgcgataggtaatcgtcgtttcggttttagaggtggacgttttgtttttttgcgttttaatattagattttgtttttagacgatatttttgttgttttcggtatttggaaagattaatcgttaggttcgagaatgtaagatttatttttttttgcgacggaggtagttaatttagttgttcgttatttttagtgtcgtatgcgtttttacgtaggattttgtttaatcgttatcgggacgtttttttagtttcgttttcggatcgttagagaggttgttaatttcgttttttttttttattttattagcgtattaatttacggcgttgtgacgtgtatagtttttgcggtcggtcggggcgggttaatggcggtggcggatacggcgggttaatgggcgggagcgttttatgcggtcggttttcgtcgtagtcgtcgttgggttttggagttagaggtcgttttgagacggtgcgcgatggatcgagggttttagtcggggaggcgtcgtcgtcgagttcgcggttagacgttttattagtagcgttcgtatcgggagtcgcggttttcgttcgagtcgtgggcgcgttcgaggggcgggttcgtttttcgtcgtttttcgtagttttgtcgggttcgagttcgcgtcgtcgtcgtcgtcgttttgtcgttcgggtcgcgcggttcgggaaacgcggtcgcgggttgtatgggtagcgttcgcgtttcgtcgttgagtcgtcgcggagtcgcgtagttttcggagtacggtgagaggcgtcgttggtttgggggcggtggtcggggcgggtacggggtattcgcgcggttttgcggtttgtaggtttttttcggcgacggagttgcgtcgcgggttttcgggcgggtttggggggtcggggtcgggtgggcgggggtttttgggggttcggggcgatcgtgagggattaataatgggtttcggagcgggtttacgggttcgggttcggggtagtcgggggtttttgggggttcggggtggtcgtgaggggtttatagggggtttcggggggggtttgggaggtcggcggagtttgggtcggtcgtaaggggcggacgggggtttcgggcgggtttgggtggtcgggggttcgcggcggttttgaggggtcgattgggggtttcggggcgggtttgggggtcgtgggggttcggggcggtcgtgagaggcggatagggggtttcggggcgggtttcgggggttcggagcggtcgtgaggggcggacggggggtttcggggcgggtttgtaggttttggggatttgaggttgtcgggaggggttgttagggggcgttggtcgggcgtcgggttttgcggagttggggcgtcgatttttgattcgcgagaggggcgttttcgtcgtgttggtcgtagttgttatttttagcgtttttattattatcgttgttttgaaatgagagtaggcggttttcgggtttcgagtcggagggggagggcgaattggggatttgggggcgtcggggttgtaggaggcgcgcgtaggtcgaggaggggtaggaatgcgggtagtcgtgtggggggtgttagggggagggtaggcgggcgggtgtggggggtggttgggaggaaagcggtggcggtggcgg

SEQ ID NO: 11418 - DNA, 1930 bp, Artificial Sequence
  Description of Artificial Sequence: Synthetic polynucleotide
cgcggggagatcggggcgcgcggtacgcggcgtttttatttgtggatgtttatttttcgtggagggcggtgggttttgtcgtaggagattttggcgaagacgtcggttacgatgacgaaggcgattatttcgtaggtgatgtagacggtgaagttggttttgttttttttcgggtcgtatttgttttcgggtttcggcgatattattttggtgttgggcgtttgtatttatatcgggttttggtagttggtgtattggcgttggtttagtttttcgtggcgttttttgtagtagaagcggtagtagtaggtatcgtagtagtataggtagtcgttttcgttgttgttatattcgaattttttgtcgtattggtcgtttacgtcgtagtagttttagtacgtttcgtaggtgacggtcgcgttggtcgtcgtcgttatagtcgtcgcgggttgttttcgtcggtttttcgttttcgggatttcgggcgttcgggcggtgtcgtttagttcgcggtcgtttcgtgttagggcgttttcggtttttcggttttcgacggtagcgtcgtttgtatttagggttcggttggcggcgcggtcgcgggtttcgtggacgttgggtagtaggtttagggattttagcgagagtagtagtagtagtaggaggcgtcgtagcgttatggcggggtcgggcgggagggcgcggggaggttttcgcggtaggtcgttttttcggcgggtcgggttcggaggattcgtcgcgcgggtcgggttggaggcgttgagcggttagcggtttcggggcgatggcgttatcgaggcgcgggcggtagtggcggcggcggcgcgcggtgcgtacggatcggttcggcgcgggttgttcgggtttttaggttgcgcgtcggtttcgcgttttttttgcgggttcggcgcgttttttgggtagttttatttttcgtcggcggtgattgcggtttcgcgcgcggttcggtttaggtaggattcgaagcgcggtttcgggcggcggcggcggcggcggcggcgtggtttcgttcgggcgggttttgcgggataagacggggagtcggttacggggtggggcgattggcgtttcgggagtaggaggagaatcgcgggtaggcgggcggggagggtgcgcgtagttttcgaggagagagattcggagtcgggaggggcgtagagttcgtttttaagacggggtttcgcggttttgcgcgtttggaatcgagagcgtacgggtcgtttttttaggcgtagttcggtcgttcgggttttttagtcgttcggtttcgtagcgcgttttcgtcgtaggttggttttttgggacggagtcggttgaggttggggttcggcggcgagtcgggagagcgcgcggcggttggattttatttatttattatgttcggttgcgattgtagaggcggcggcggcggcggcggcggcggcggcggggcgaggcgggaacgtagttgtcggagcgagcgagcggagagtcgtcggttcgtcgtttgtattagtgtcggaacgtgtgcgagagtgagcgagggagatatacgtatttatatattcgtatatacgggagcgtcgcgaggggaggggggataggggaggggagggtagtcgtttttcgttatttacgtttgtacgttcgggcgtttagggtgcggggcgggggggattttttttcgtttttttcggatcgtagtagttgaagtttcgcgttacgaaagtttcggatagtagttattcgatacggcgaattcggcgggcgaagagggggtcgggagtagggcggaacgttcgttttgtagtcggttcgcggtagggattgattttttttgttattgttttttttagttttcgcgattagtttttattttatcggagttcggggtagcgcgttgtttgagcgg

SEQ ID NO: 11419 - DNA, 3177 bp, Artificial Sequence
  Description of Artificial Sequence: Synthetic polynucleotide
cgtaggtggggtaagttcgggttatcgacgagatttgttcgcgttttcgtttttattttggtgtttttttttttttttggtagttttttttttattcgtttatttttcgggtttatttcgatttatttggcggtgggtttttttttttttcgattttcggcggtgcggttcgttttttttttgatttcgcgtttggtcgtcgtgtttcgaaggatatgggttatagatcgtgcggagatattagtttcgcgggcggttgttttggtttaagtagaagaaaattatcggggttagcgtcgggtacggtagttttttcgtttcggagttcgcgttgttcgggtttttttttgttgatttcggtttcggtcggttttcggttttcgataggtcgttgagtcgtatgaagtttcggggttgtttcgatttttcggcgttcgttttattttttttttcgtttattttttggttagtcggggtttcgggcgattcggagaggggtaagcggcgttttttagaggaggtgtttttacgtaattcgggggtttcggcgggggtatatttggtgggttttagggcgtaagttgagttttcgggagggttagtttagtttagttttttttgttcgtaggggtatgttgttcgcggggcgtcggggcgtagggaaatttcgttcggcgcgagtttcgttttttttgcgtttttggggtttttcgggttagtcggtcggtttttttttattttgtttcggttttttcgtttcgcgtttaggtttcggttgtcggattcggcgttattttcggcgaagtcgtttcgagagggcgaacgaaaaggggggtagcggcggagggcgggggttcggggaggggcgtttttttttttcgcggcgtagttggagtcggatttaaggggttagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttgtcgttgtcgtagttgtcgtcggcgttatagttttttttttcggtcgagacgcggagcgagcgagcgaaagcggcggcgaggagtttcgcgtatattatagttggattttttattttaattttaagtttcggtttcgtttttagatagtttcgtagttaatcgtcggacgtcgtcggtttcgagtcgcgcgtttattggtcgttcgtcgtggtagtgcgggcgggagcgtagggagagaattatagttggaattcgatttttattttaaaatttaggatcgttttttttttttttttttgtttttgggttcgttttcgaaggttggagttaattagattgttgtttagatcgaatttatttttttattggttattggggtttttgggatttttttggagggagttcgaagaattagagtattcggcgcggggttttggcgtagggtcgtaggttttaggtattttttgtttacgatttttgatttgggtagtagtcggaggacggagtttagttttgggcgggtttggggaagaaaggagataggcggtacgggggtgagggttgttattagggggttttagagcgaaattttaggtttttatttggttaattttttattttggagttgagtttggttgcgggattgggggagggaaggagcggagttggatgttttgggggtggggttttaggttggaggggtttagttttggagaaacgggcggagttcgagaaaggttagggtaggtatggtttgggcgtggtttttataaattttttgggtttattggttatattttcgagttaattttgagatttcgattttgatttcgtaattttaattcgttggatttgattttatattgacgtttttgggttttatttttttgtttttagggattttttgaagggcgtggattttacgtaggggtttcgtgtttgaatacgtggttttaggtaggtcgcgttggatcgtagagttcggatttttaggaggggttgcggagtagagcgaggatttttaagaaggaatttgtgggggtttcgagtgtgtgggagggggcggaagtatagagttgggttttatcgattcgatttttaaagtttttattatcgttattttttaatttcgtgttttagttttttttaagtttttatgtggtttagggaaagagtgttcgcggaattggaatttcgcgggtttgtcgtttttatttatttattttaattttatcggtagcgggttttcgtgggtttgtgttttttacgcgtgtatacgtacgcgtagatttcggtttttgtttcgtttattttttcgagttttggggtttagtcggttttagtttttttttgtcgtcggcgttattttagaaagttgtgggtattcgggagcggagcgtcgcgggtgtgttgggcgtcggtggaggggggaatagcgaggattagacgtcgggaagtatttttttaatatttgcgagaggtagatacggcggaatttagtgggttagttagtttttttttcggagattttggggcgtttgcgttattgcggagaggcggcgggatgggtcggatgatttttattattattttttattttgttgaggttattatttttgggcgttgtttatttttttaaggttgtattatttacgtagttttcgcgtatttttcgttatcgtagagggttggggtcgttttagttttcgtttcggtcgatggggggaggggatgggggaagtggtagagtggttgttgcgtcgtcgtttttttggttgttttttcgtcgaatttatgtatagagttgtgtaaatgaggtcgggcgggtttatttgtattttatgttaatgagtagattttttaagtgttttttttttttggcgggagtttttgtttttattttgagtatgcggcgtttgagttttgaatttcgtgtcgttttttgggaaaggggggttatttatggttgtttcgcgcgtttgatatttttttttttttcgagaggtcgtagtttgtcgggtcggtttgtttttttcgttaggatagaggtttcggggttggcgcga

SEQ ID NO: 11420 - DNA, 2195 bp, Artificial Sequence
  Description of Artificial Sequence: Synthetic polynucleotide
cggtagagaggacgttatttacgagagagagtgatcgcggatttttatcgagaggtaggcggtggaggggttttttttggagatttcgattatggagtggttttttttttttttagttcgagtcgtagcgtcgggtttttttatttttttagtttttagtcggttcgggtttgaaaatttttagcgatcgagcggagttggcgcggcgtttttagttcgtaggatgtttagttttttcgtttttgttttcgtttatttttcgtcgtttcgattcgattttttcgggcggcggagcgggaaggtagtagtttttatttgggattcgtcgtcggtttcgttttagcgtagcgtttggggttaattttagttttaggcggggggcgggcgggggtgggagggacgcggcgcggggcgttgggttaggttcggttttggttgggatggcggggttcgggtcgggacgtagggtttgtttttttttgggatcgaggttgagttaggcgcgttgggttgttcgttttcgcgcgggtttgtttttaggtagggttttttgttttcggcgagggtgggttggagtttgtattatcgttatattatttttatttagggcgttaatcgggcgttcgtcgcgttttaggtacgtgcgtttcgtttatataggaataaagtttgttcggtttttttcgtttcgatttatttttaggttgagtcgattcgtatttttcggttggtgagggagatgggagtttttggttttgtcggcgtgtgggttgttgttgttgattgttacgttttcgtatgcgggcgcgcgtatatttacgcgtatttattttttgggttcggttttcgtcggggtaattggtgtgagggtgtagttttgcgtattttttatcgcgttttttagagagcgcgtttacggatacgcgcggggttattttggcgcgttttcgtgggggatatttagtttttgttattttcgttttggttttttcgtgagatatattttaggtatagttcgttgggagcgggtcggagcgaggcgtatatttaagatagagttcgtttttgttacgttttttgcgtttttttttttttttagtttgtatacgtggatatatcgtatatcgaggttcgttttttgtacgtacggtttttttttgggatttttattagttattaagcgtacgtgggatcgttattaagcgttttttttacgcgtgggtcgagtttagattattttggatcgtgggtaaaggtttttttcggttcgattatttcgcgttcgggttttttgtgatcgttttaggttttgtttaattcggagcgcgtttttttttttcggcgttttcgttttttgtttcgatttgttttaattagtttttacggttttgtttttcgaggtatagtgtttagcgcgattttttgggtttttgcgtttcgggatacgttggttttgatttcgagttcgttttttttaggaggttaggtttttattagttttattttttattttttgtttcggggtggatttgtgggttgttattttttttttttcggttttaggaatttgttgaagttggatcgtagaaattgggaagcgaatttaggttggtatttatttagttcgataaataagagatttttcggtcgttttttttcggggttgttggtttcgcggggggtggggtgcgtagttttgggggttcgtagcgaggtttagttagttcgcgttagaggttcgtaggggttgaggcgtatagaggagggagaggttgttgggtttggttagggttttggagacgcggagggagggtagggcgtcgagtttcggggtgtcggtttttatgacgtcgaattgtttgggggatcgttagcggtgcgtcggtcggagttagttggtggcggggcgggcggttcggagtgtttgtttaattttgagcgttcgcgagggggaggggaggtagttggttacgggttagggggtagtaaggtggaggagcgggggttgggaaaggggagggtatttttcgggttgtttgtttgcgtgtttgtcgcggtttacgataatcgggagtttaaattttatgaattattcggagttgttggagcgataaattttaggttggttttttttttcgtatatcggtttttcggatttttggagggaatgtttgtttagcggtcggagttggcgg

SEQ ID NO: 11421 - DNA, 2063 bp, Artificial Sequence
  Description of Artificial Sequence: Synthetic polynucleotide
cgtttaaagtagaggcggtaattaggcgttcgggttacgttatttgataataggatagatgttgtacggttcgttttttttatacgtattatttcgtagttcgtagtatcgttagaaaatttatttgattttagagtcgtagagcgtttaggggttttttttcgtttattcgtagtacgtttcgggtttttttttttttttaaataacggtatcgggtttttgtattaaaatacggcgggttcgcgtttgttattattagtgtaaaatttgcggggggttgttcggaaaggatcgaattttatcgttgtatgagttttaaaagggagggggtatatttatttttagttttttattttattttcgtttgattgtgatgtatatcgggcgtttgtatagtttcgttttatattagtatatacgcgtttcggtttcggtcgtttttcgtcgttttttttaaattcggtcggttcggggtttggcgtcgtacgcgggtcgttaggggttagcgttcgtttcggttcggttcggtcgaataaagggttcgcgaatttttcggtaaagttgcggttgcggcgaggagcgggcggattgtcgcgtttatttgggtttcgttttcggcggcggcggcggtttcgcggggtttcggtggcgcgggtttggcggcggcggcggtacgaataatcgttcgagggtttcgggagtgcgcgggcggcgggggttcgtttagcgtcggcgttacggatttaggtttcggcgcgggcggcggcggcggttgcggcggcggcgcgggcgagtgggcggcggcgcgtttcggtaggtttaggttcggtttcggtaacgtcgcgacgcgtttttttttttacgttcggcgggatgcggtttcggcggggttcgggttttaggcggcggcggcggcggcggtggtagttgcggacggttgggcgcggggtcgtttcgtttttttcgttttcggttcgggcgggtttgcggttattgcgacggtgacggcggcgggagcgcggcgggcgttgggattgttttgttagggggcggttcgggcggcgtttaagattgcgcggcggcggggtcggcggcggcggttacggttttcggggtcgtcgcgttgaggtgcggagttgttatcgcggttattttgttgttttaattgataagaattttttttttttcgttttagttagacggggcgttcgcgttttttttttcgtttcgcgttggtttttaataggaagtcgtttcggtttttagtacgtgatttttatcgtatttgtatatcggagggcgaattggttaatcggtattttgtatttgagtttttttttcgcgcgtttttttcggtttattggtttttcggttaggttacgtttttttttttttttttaatattcgttcgcgttgtggttttttgtatcgcgcggggagcgcgtcggggtgcgagcggtgcgcgtttcgagtggtcgggacgcgcgttagttttgggagtttgtattgttcgggggggttacgtggagatttgcgtggtgttttttatcgtcgtcgtttgtttttcggtttttgggcgttgtggtttcgcgttagggtgttggcgggaggggtgtcgattcggttttgcgcgttcggtgggtttttcgggttagcgtttcgcggcgttcgggttttatgttgtaattgcgttcggcggcgttcggcgttcgtatcggcgcgcgtttcgttcgtgtcgtgtatacgttttgtatcgttttattttgtatacgtatacgtatacgagtttttggggttttggagtatcgtgttcgtttcgcgtttttcggttcgtttttgcgtttagtcgttttttagggagcgtttagttgcgagtaaaataagtttcgttgcgaaatagtttttcggggagatagtttttttttcggagtatagatattatatttttatcgcgtaagttttcggttcgggtcgaattcgggcgtttcggcgtttacgtattttacgattttttttcggtgtttcgtacgtcgtcgtgattttttattttacggtttttcga

SEQ ID NO: 11422 - DNA, 816 bp, Artificial Sequence
  Description of Artificial Sequence: Synthetic polynucleotide
cgtagtaaagagtttcgggcgttttgggggagagcggttttaagtttcggaaagtgggtagagtttttttttttagggttgagacggtaggcgcggggtttttttcggattcgtttcgttaaggggatagtgtaggtcgtgtcgcgatttagattcgacgttttcgcgggtttcgcggcgttcgggttgttttcgtcggttgggagcgttcgagtggttttcgggaatttatcgtgaagtaggagggtcgggaataggtatttgagtaggaggcggcgcggttaggatatttttagttttgttttggggtttttcgtacgtcgcgtttcgatttggtgttcgggtaattgggcgcgcgttttgtttttcgttttcggtcgggtgcggtcgggttaggtcggggttttaggcggttgtcgcgcgttttatgttcggcgggttaggcgcggggttgcggggcgcgcgttttttgggcgtcgtcgggcggttgtgggcgtttcggttcggttcgcgtttcggtttttttgtcgttcgtttcgattttttcgcgttcggtttcgcgtttcgtttcggtcgtcgtgtgcgtcgttttgagttgtagtggtcgttatcgttatcgtagttgtagcgtttttttatatttttagcgcgtcgtcggtcgggtagtttggtcgcggtacggaggaggggttttggagggggcggtcgggggaggcgacgtcgagttatcgttttcgggtagtcgtcgtcgggggggagcgcggagatttgaaagggcgcgtcgggtaacgttttttttttttttatttcgggcgt

SEQ ID NO: 11423 - DNA, 368 bp, Artificial Sequence
  Description of Artificial Sequence: Synthetic polynucleotide
cgtgtcgtttgcgttcgtgggttatatatattttttttttttttattgttttttgggcggtgtggattagttgtagagtgtgatttgcggttagggagtgttttttcggagttttcgtttttagatttttggtgttaaagacgttttgtgagcgggtggggtcgggcgttttagttacggcggtcgtcgtttttttttttcgtaggacgggatagcgtttttgtggatcgcgttttagatgggttatagcgaggtggtgcgggtgatgttgttgcgcggagtcgatcgcgacgttgcgcggaacgtgagtgttcgagtcgcgcggttaaagagcgaagtttttcggcgcgtttgtgtggagaaaacgg

SEQ ID NO: 11424 - DNA, 1411 bp, Artificial Sequence
  Description of Artificial Sequence: Synthetic polynucleotide
cgtttttcgcgtttttttcgcgcgcggtttttggagtttttgaggcgcgcggttagtttagttcgggttcgtagtatcgggagtagttcgtcggttaagcgagcgcgggtcggggtcggggtcggggtttgggggcgtcgttttcgggagtttttttgcggtttttgaggagcgagggcgacggcgaggttgatcggggtcgaaattatgaatcgaagtttttataagttttagattttgcgattttacgattgtagcgtagtggaagttaagagtaaggtaagtttttcgttcgtttcggcggttttgcgtttagttttttggttaatgaatggggcgtttcgcggagggggattggggcggcgtggaggcgataggcgtcggcgataattttttagttcgggcgtcgcgcgtcgtttcgcgggacgcgtattggggatttcggtcgtttttttcgtttttcgcgcggatataaagttcggtagtcgcggcgtttagagggtcgagggttatcggatagttcgggtagattttggattcgtttcgcgggagttgtttttttgttttacgagtgagaggcgatcggggcgcgttatatattggaggggagggcggttttttcggggcgagttgagggttaggggttgttcggattcggggtcgtgggggggttttgggggttcgggtcgtgggatggttttggttaaggcgtttttaaggttgtaaaggaggtttgttatttgttaggaggagatttgtcgtcggtttcgagttcggcgttttttattcgttcggtattaaatatttaggtattaggcgcgttttttcgcgtagatttagagtacgtattcggttttttttcggtttagatttagattacgttttttcgggcgcgttttcgggttagatattttattttatttttacgggcgcgtttttattttagatttttttattttcggacgcgttttcgttttagatttagtttattttttcgggcgcgttttcggtttagatttagatttttttcgagcgcgttttcggattagattcgtatttagattatttttacgggcgtgttcggtttttttcgttgtttgcgttcgggcggagcgtgttcgaatttgcgggtcgcgatgcgcgtttgggtaattggttggtaggatttggcgtttttgttttttgcgggggtggttttttcgtcgtagatgttattgtttgtgagggtttttttggtggatttcgcgggttgaggaggtgttgtagttgttcggggttttgcgggagggggtttttcgagtttttcgttggttattttttgggagttgagcggttttttcgtttttttttttttcgtatttcggtttttagagttgtgggaaaggtttttaacggcggagtgggagttcgt

SEQ ID NO: 11425 - DNA, 1487 bp, Artificial Sequence
  Description of Artificial Sequence: Synthetic polynucleotide
cgggttttgcgattcgcggcggaggcgtatagtaggcgtttaaacgatcgtgggtttagggtttcgcgttagcgttttcggggttttttggagagaggtagggtttcgtcgtttcggttttcgtaggaattagttggagaaaggcgggcggtttggggttgaattttttttattttttatttttttcgtcgtttggagtagatacgtcgtcgtcgcgtttttgggaacggttagggaagtaagtagaagtcgggaagtcgcgaaagaggcgagaaagtgcgattttttttttagattttcggtttttcgtcgaaatttttgtcggtcggttaaattttagataatggaagttttacgtttttatttttatttttttttataagttcggtcgcgggtttttttcggttcgggatttcggcgttagtttcggagtcggagtttgtacgatacgttttttttcgtcgttttatttttttattcggagatcgtttatttttttcgttttatttttttatttttcgtttggtcggtttcgttcgattcggaggcggcgtttttttttttgttttaggtttaggaaggaggacggcggaggaagtagggggttttggttgcgggcgtagggatgtgggtcggcgatcggcgttcgagggcgtaaaaaggcggttcgaggattgcgcgcgggcgggtagcgcgggaagtcgggaagaaaggagggcgcgcgggggaggaggttgcgggtgcggggttcgaggtcggggcgtttattttttcgcgtcgttcgcgttcgtcgtttagttttcgttgtaggttttgcgcgcggtttttcgtttcgttcgtttgttgttgtagggtttggattttgcgttttatcgtttttagggagttgaggtcggttatggcgcggaggcgtagaggcgtacgggtagcggcggacgttcggttgggttcggtttcggcgagagttgtatagtcgcgtttcggttttttaagtttttgtttgcgcgggggtcgttttcgttttttttcgtttttcgggtcggttgtcgtcggggcgatgaggttattcggtcggatcgtcgacgttagtatcgttgggggagggtttgacgtcggtatcgttggttatagttgttggaaagtgttttttttcgggatttatttggagaaagcgttgggaggcgtcgttttttttttttttttttttttttttttttgcggtttttttcgttttttcggtttcggggtttcggtttggtttcgtcgcgggttttcgtatttttgtatacgtacgtcggaggttttttttttcgtgagttttagttttttttgcgcgttttttaggttttcggaatatttatttagttcgttttttgttttttttagttttttttggaggtgcgttagttttttttttatttggggacgatagagcgaggaacgggttagtttggggggggggttacgttttcgaggtgtaggggcgg

SEQ ID NO: 11426 - DNA, 602 bp, Artificial Sequence
  Description of Artificial Sequence: Synthetic polynucleotide
cgcgtatcgttgttgtattttttttaacgtattcgtaattttttttaacgtattcgtattttttttaacgtatttatattttttttaaggtattcgtattttttttaagttattcgtattatttttttttttattttatgcgaagattgtagtttcgtagttttgcgattagcggtcggaagtagttaagatgttattgtttttagtatgtttcgcgaggcgcgtatagtataggtttttttttaaggttattatttttattttcgttgtatgttgggattgtagttcggtcgttttgtgattaacggttggaatcgtttaagatattattttagttagtatggtcggtaggagcgtatcgcgttgtttttttttagggattcgtatcgttttataattttgttttgtgttgagattgtagttttgtaggcgtataattaataagttgggtgtagataagagattatagtttttcgtattttaagtaaaggttttttttttacggagtttttttacgcgtttattgcggtttcgtcgtgttaaggggagtttggttgtttacgggttttatttgttagcgagaagatagtttggtcgggcgg

SEQ ID NO: 11427 - DNA, 628 bp, Artificial Sequence
  Description of Artificial Sequence: Synthetic polynucleotide
cgttttatcgagaatagaaagtgcgttttaggtattattcggatttcgttaaattatattatttagaaggtagtgttataagggacggaagtcgattttaagttatagacggaaggcgtagaggggcgttttcgtagcggcgtgggcgggattttcggcgtttagttttcgttcgtcgttaggttgcggttgttgtggttgttaacgttatattgggtagaacgttagataggggttatttttcgagatcgagtagagacggatagtgaggaggataggatttatttatacgtttttatgttagtcgcgattttatttttataagcgtttgtaaaattttttttggggttttggcgatagttttgtgtttttacggcgcgtagaggcggcgtcgcgaattttgtgtgtattttatacgacggcggggattgaggtttttcgtagtttagagtcggagttcggggtcggtcgagttcgtaggatcggttttttcgtcgatttttacggttttatttagttttttgggtttatggcggcgtcggcgttggtgagtggagggtttcgtagttcgcgcgagttcgggttatcgttcgtatgtatttattcgttgtaatacggcggatgtcgg

SEQ ID NO: 11428 - DNA, 215 bp, Artificial Sequence
  Description of Artificial Sequence: Synthetic polynucleotide
cggttgcgtattgatcgtatttgttatgttttattttttttaatcgaagttgaaggtcggtttcgatgtttgttattttttataattttatcgtagtcgatagttttataaatattatcgttcgtttagttttcgttttttcgggtcggttgttatttcgcgttttcggtttggttttggtttcgtcggttgtattgtacggttcgttttttcgt

SEQ ID NO: 11429 - DNA, 2638 bp, Artificial Sequence; identical to SEQ ID NO: 7166
  Description of Artificial Sequence: Synthetic polynucleotide

SEQ ID NO: 11430 - DNA, 2172 bp, Artificial Sequence
  Description of Artificial Sequence: Synthetic polynucleotide
cgcgtaggttgtgtacgtgtttgtgtgtacgtgtttttcggtgtgtgttttagttttagtgtgttggcgcgtgttcgagtatagatatatcgggggtgtttgggtattcgtatatggttgcgggtggggcgtagtggagaggaagtttatatatgcgtgtgttgagatatggtcgtatttttgtgtttttttagtttagacgtaggggagattagtatcgagatattcgagttcgggagttttttagcggcggtcgggcggagtttggttttacgtggggttggagagtacgtaagtttggagtttcggcgttcgtttttcggttgtcgtcggtttttgtagaatcgagtggtcggatggtagttcgcggggaggttcggttattcgttcggttcgttcggggcggggagaagaaggagagttggagagagaatcggtcgcggcggtcggagaggcgagcggagtgtaagagaggcgagcgtttttgttcggcgttcgggcgcgtttttcgtttttttcgttcggttcgtttgttcgttggttttttttttttttttttttttttttttttttggttttgtttttttttttgattttcggttggatgattgaggtattttagacgtgggttgaattagagcgagcgagcgagtttaggggttgtagcgatttttcgataagttatttagaggcgattttgtgcgcgcgcgttttttagtggttttcgttcgttttttgattatgttgatatatttataggataggtagtagtatcgatgcggcgttgcgacgttatagttttcgatattttttttttataatttagttttattttttagtattcgatttgtgaaaattacgtttatgtagtaatataattggttcgaaagcgttaaagagttaattaagaggttttcggtttttcgtagtttatagcgtagttcgattttttagagtcgtcgagtagacgttcggtgaattttagaggcggcggagggtggcgaggagttttcgttttttttcgtttttttttttttcgatttcgttttttttttttttttttttttttttttttttttttttttttttgttttattttttttttttttaaattttttttgttttgcgcgtttggatatagatttaggaagcgaattcgtttacgttttaggataaggaagagagagaggtacgggagaagagtttagtaagatttggattgaaatcgagatatttttcggaggttcggagtagaggaaggaggaggagggcggcgaacggaagttagtttgtaatttaagttttgatagcgttggtagaagggggtttaaattagatttttttttttttaaaggagagagatttttttcgttttttcgttttttgttaaagtcgggtttagtatagttgtagacgttattagtgagaaagagggagaggaagatagatagggggcgggggaagaagaaaaagaaaggtaaaaagttttttaggagaattttttatatttgtaataaaagatttaggggttggagagagatttttgggacgtagggttggagtgtttatttcgagtttagcggtagggttcgggcgcgagtcgagattttgttcgtttttttcgtttttgaaatcgacgtttaggagcggttttttaaaaacgtaaggtataaggacggttattcgcgcgattatgtttgttgatttttcgttttgttttttttaaaagcggttttttattttttaaaagatatttttttttttttttttgaagtgtattagttgtgatttttgtttttttttttttttttttttttttttgttttgttttttttttttttttgaattatgtgttgttgttaaataataataaaaaaataataaaatatagtagttgcggatttgttttcggttggagtttagcgtttcgtttggagtggatgagtttttttatgagagattcggttatttttgggataagtatggtttattattcgtttttattttatcgggcgtcggatttcgttatgagcgcggtgttgggttattagtcgtcgttttttttcgcgttgacgttgttttttaacggcgcggcggcgttttcgttgtcgggcgttttggttaagtcgattatggattaattggtgggggcggtcgagatcggtatttcgt

SEQ ID NO: 11431 - DNA, 2548 bp, Artificial Sequence
  Description of Artificial Sequence: Synthetic polynucleotide
cggagttgtagtagaagcgttttcgatttcgtttaggtttttagtttatttttttttgaaggtcggtagggggcgttattatcgttggttttttcgcgcggtttcggttttcgtttcgggaatcgagtgtttgtagttcgcgattttggggaggtatagggttagggtatcgtttcggcggagaaagtggttgtgtcgcgcgggtggggtcgggttagggttgggttgggttggagggcgcggggtatttgagtgaagtcgtagttttcgggcggggtgtagaggagattttttgagcgttggagcggggagagttagggcgggggttaggcgtcgtagtttcggacgaggttcgagtagtttttgcgcgtttcgtagtaggtttagtagcgtgtgcgttagcgagcgtagttttgcggatcggataggagtcggagcggcggttagaggttggttaggtttttttttttttgtttttcgttcgggttcgggtgaatagaattgatcgtatcgtcgtcggcgttgtaggtattgttggtgcgttaggcgcgtataggcgttttgggatttcgggtataggcgggtatagaaggcgtagagtcgggcggcgtttgtttgtagtttttggggggggttttaggttagaagttttttgtagttgggttcgcggttggaggaggttgttgcgggcgggataggggttagtttattttttgtttggggttttagtttttttatttttttttcggaaggagataggttttttcgaggtagaagggagttgggaatgggtatgggtcgggtggaaacgggtttgttttacggttgttcgttggggtattggggacggggtattggaaagagggcgtttatcgtttatttgtttttggagttagtttttgaatattgttacgcgggtgtagatttcgggtttttttggtttttcgtagtcgtttttttaggaggtgatttcgaataggatttttttagggcgggggttaggtttagaataggttagggggtttttcgagttattttgcggggttaagagagaggacgttgtatttatttgttttttatgacgtttgttttacgtttggtaggtgtgagtttgttatttgtgtttattttagggatgaggatagagaggtttagagaagtcgagtgatagatagacgtggaaggaaaagaggtcgtagtggttttgggaaggtttagtcggtttttttttattagattgggtttatatttggtacgagttaacgtttttcgttaggtattcggcgtagagtatggtgttggggcgtagttcgggttttagggtttttcggtaggtgtcggtgttgagtaggggaatacgggttttttttattgttttagttttaggttcgtttgtagggaaggggtggaaggtttaggtttggagggtaagagtttcgttttgagggttttttttttattattttttttgatttttttttttttgaaagagtaggtagtatttttttaaggtaattcggtttttttatattttattatttcggatttttagttttttttattacgcgtcggtttatttacgtttagtattttcgaagagggcgttttagttcgcgatggcgtaggcggtttcggtagggggtttttggggtttttggggtaggtatacggggcgcgtcgattttttcgggtttatcggcgtttatagttgtattagggttaggtcgttgtggaaggttcgcgggttaaattgaggagggggaggcggcgtagggttaaggaagtacgggtgggggtgcggtgtttagttttgggggtttggggattgtttttttattttggggtggggtaggatgcggtttattggtatttttttcgtttgtttttttcgggatttttttgttagcgttatagtttatagaagtttattcggggcgttgcgggtcgagcggtagttgagacgtaggaaggataggggtatatttcgtaggtttttcggagattttgttttttcgttcgtatgtcgggttttttttatttgggggtacggagggcgggtcggggaggggtttcgttttagagggggcgaattcgttcggtcgtgttatttttttcgggttggtattttggcggggcgggcgcggcgttttgagatggggaagttcggggtcggtcgtcgttagggggtagtagagattatttttttcgcgcgtcgttcgtcggataattcggtaggtgcggggtttagcgtcggggattttagttgggtaaggtttgggggttttatttattttataaagtagtgcgttgtcgtgagtatttaggaggtcgttattaggacgtcgtcgtatagaggttgttcgtcgagttgtagttttattagttagggttaggtttcgggcggcgtcgcgttgttttttacgatgcggtcgtgggttcgcgttatattggtagtgttcggacgtttttcgtcgtacggttttagaaaggggtaaggggtgttacgagggatatgttttggttattttcgttttcgaggtttattcgg

SEQ ID NO: 11432 - DNA, 919 bp, Artificial Sequence
  Description of Artificial Sequence: Synthetic polynucleotide
cggtggggtgtgaacgggcggaagtttcgtttagtgtttgtttaattatttttagtttgtggaggtcgagcgaatgcgggtgtggggttcgggtcggggtatatttacgcgttgcgttggtatcgggattggatgtagatgagtaggcgtaggtggtttcgggggcgcggcggtttttttttcggcggtttttcgagcgttgcgggggagggtgggacgtggttaagcgggcgggcggcggggtgggcgatagagcgggcgatttttttacgtttcgggttttatttacgtgtagcgtggcggcgagagcgtagaagttagttacgggcgttttgtattggtcgttggttaagtttaggttcgggtcgcggcggaaggtattttcggcgtcgggttgcgaggggtacggatggttatttcggttttcgttcggtcggatttattcgttttttcgcgcgtcggtatttattaggtagtagacgttaagttcgtgtagcgcgcgtcgttttattaacgcgtttcggcgtaggcggtagaggaaagcggtttttacgcgcggcgttcgcggtttcggggttaggggcgcggttagtagtgttagtacgttttttattacgtcgtcgtcgtttttttcggcggtggtcgagatcggggcgaggttcgtagcgatcggttcggcggggttatacgtatagggttcgggtttcgcgcgttttcgttgtcgtatcgtatttggtatagagcgagcggtggtcgcgcgttagggattttttattcgttcgtcgcgtgggtttagttttgaacgataggtgttagcgagattaggggtttgtcgggcgtaggggtggggcgagggcgacgttttttcggtttgaagggtttcggagtttttgcgttttgattttgtagcggttttcgt

SEQ ID NO: 11433 - DNA, 2488 bp, Artificial Sequence
  Description of Artificial Sequence: Synthetic polynucleotide
cgggtcgagttcgaggttgttcggaggtttagggtttttatttcgcgatgttagttttgtttttttttgcgtttcgggtaagggtttgttcgtttgggggatcgtatttggaattcgcgtggttttttttttcggcggtgtcgtttttacggatagtgcgtgttcgggtttgggttggagcgacgttttcgagattattttattattttataattgtggttcgcgcgtcgttaggattcggttcggtgtgggttggcggagtataatgatcggcggcggggcgggggcgggtacgcgggcggcgggcgttgggggtcgcgtagatgtttgggtcgaataggtgagcgtttttcggatattcgggtgttcgtggggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgagagtcggttacgtgtttggtttttttagttcggggtttcgtttcggtcgttcgggggagtcgaatttcgaggttcggtagtttcgttttataagtattcgcgtttttggggattcgaaagacgtatgggggtcgaaggttgttcgaaggggtttcgggcgtcgagagtttttgagggtgtttgagttattttatttgggttaagttttttttttttggtttgatcgtagatagttcgtcgggtgttttttttttttagtttttatcggatttagagatcgtagttttcgggagcgatgggtaggtatagattttagcgtttttttttcgggtttagtttcgtgtaaggatttttttcgaagcgttttttttttaagagcgcgttttttatcgaagcgtacggcggcgcgtttagcgcgtttttatttttttttatttggtttagttttttttttttttttttttttttttttcgcgttttttttttttttttttttttttttttttttttgggtgtttttttttttttttttttttttttttcgtgtttattttttttttttattcgttttttcgttatttttttttgttgttttttttattttttttgtttgcgttttttttgcgtttttttttttttcgttttcgtttcgtgttcggtttcgttttttttttcgttttttcgtgttcggtgtttttttttttttttttcgggtcgcggcgtcgtcgtcgttgtcgtcgttgttcgtttgggttttttttttggttattttcgttttcgggtcgggtagtgacgcgtcgcggtggtgttagttttttttttcgggtagtcgcggcggtagtagtagtagtagtagttggagttgtggggttgttatcgtcgttcgtttcgtttattcgcggatttcgatcgtttattttcgtttcgtttttagtttaggtacggagttcggttcggatttcggcgatcgggtcgttttcggggttcgggtcgtcgtttttttttttcggttgttgtcgtcggtcgttgagttgcggttaggggggcgaggggttgggggcggttttggggaggggggcgtagggggagttttttttgtcggggttgagggagggggcgcgggggagcggttgcgttttgggtcgagtgggttggggcggggggcgggtgagtgtgttcgagagtggagggggggcgatgaaggttgtattgtgggggtcgcggggcgtttaagaggtgtgtttggttttgagcgtttagggtcgcggggcgtattttattttcggggtgcgcgtcgcgggttttggggggcggtgattgtgcgcgtagcgtcgcggtattgtgttacggtcgttcggtgtgtagcgggttcggtatcgcgtttcggcgagggaggcgttttttggcggcggggcgggggtcgggttcgggttgtcgcggtcgttacgagaagggaagtggattgtgtttggggatgtgaggacgggaagcgttgagtgttagggaggggtttttcggcgcggcgcggggagttgagacgcggtttgtagagttgagtttattttagtaggttcgggtttttttcgggaggggacggggtgttttttttaggtgtatcgtttgatcggaagtcgcgggcgttggcggtttttggcgaaggggttttttttaatgaggggatacggcggggcgggggtagtcggtcgtttcgagggcgcgcgtaggggttaagttggatttatattttcgtttttttttttttttttttattttgtttttaaggttggatattttggatagggaggaggggggagtgtaattcgtatttttattttagtcgttcgggagtagaagtgattttgtttttattcggagttgcgtttgttcgagttcggtcgtttttatcgggttgcgt

SEQ ID NO: 11434 - DNA, 513 bp, Artificial Sequence
  Description of Artificial Sequence: Synthetic polynucleotide
cggtcgggtttgttacggggttttgtgtagttttttttattttttcggttgttagcgtttcgtttcgtttttttttagtttttaagggaggaggggagagttgtagagaggaggaggggtcggggaggtcggttttataaaggcggttggaataattttgttcgttagatttcgtcgttcggattttttgagttgttcgttattttacgtgatcgcgtcgttttttagttttatcgttgagtgagttggggcgcgtttttatttcgtttttagtttttcgtcgagtcgcgtggtgtattgaagtcggcgtggggaggagagtcgatgaaggagaacgttaatatgggggttttaggtagaatttttaatgggagagatttaggatttgagggagtcgggagattcgggagtttacggtttggtcggttattttttttttttttcgggcgcgaggtttatgagatcgtaagttattttttaagaatgcgcgtgtagtcgttgtcgtggtaacgt

SEQ ID NO: 11435 - DNA, 1766 bp, Artificial Sequence
  Description of Artificial Sequence: Synthetic polynucleotide
cgttttttgtttattcgcgttaggtcggttttttttcggttttttttgtggcgcgagggatagcggaaattacggtagatagtatttttttgagtttaattttttttttttcggaggaagtcggttttttttttttatgttattttcgggttatttttggataatagttgttatttttatttgagtcgaagttaatttttcggggagttttcgggcgcgtataggtagttcggtttgttttgcgattgagttgcgggtcgcggtcggcgtcggtttttttaatggtaaatgtgtgtggttggaggcgagcgcgaggttttcggtaaaggtagtcgagtgtttgtagatcggggcgagttttgtgaaagtagataaaagaaaatatttattaacgtgttattacgaggggagcgttcggtcggggttgtcgtatttttcgcggaatatttggttttttttagtttcgagagaggagaagaagaaagcggaaaagaggtagatttacgtcgtttttagttaagtggatttgatcgatggtttttttgaatttattacgatatttgatttattagcgatgttttttggtttgtgtgttacgtatatatacgtgtatataaggttttggttcgtttttttttttcgtttttagtttttgggcgaattttatatttgttttaatttttcgtcgagggcgagtaggagcgagagtgtgtcgagtgagtgtgcgtttgtgtgtttcggcgagggtgcgcgttcggcgtcgggagcgcggttagtcgagttcggaggtatcgggaggtcgagagtcgtcgggattttagttttgcgtttattgtttcgttcggagttggatttcggggtcggggtcggggtcgtgcgtcggggataggtagggtcgggtcgcgggtcgcgcgttttttaggtcggaggtaaaagcgttagcgcgcggagggttcgaggagggtatcgcggttgggtttttcgcgtttcgggttttagtcgttcgcggttttcggttcgacgtttttcgtttcggagcgcgttcgttttttttgcgtggaggtcggcgggtaggcgagcggggggcggtagcgtcgtgttaaggggttggttggggtagcgtggtcggtcgggttggggcgatttaagagcggttcgggcggggtgcggagtcggattttggttggggcggcgcgcggggagggggtcgggggcggtggcggcggcgttggggggcggggaggaggtaggaggaggagtagtagcgttcgtcgggggatgtagtagcggtagcggcggcggcggcggcggtagcggtagcggcggcgcggagttttttgcgtttagcggttcggtcgggttgcggtagaggcggcggcggcgtttcgtttcgggtgaggttgtcggggtcgtgcgcgttggtgagtggggcgtggggggtaggtgggtggttgggggacgcggggttcgggcgggggttcgcggcggtcggagtttttttcggcgtgagttcggtcgcgagcgtcgtttaggtgagtcggggttggttcggatcgttcggttttagttttagcgttgtttgcggaggtgggttcgggcgggcgggagggaggtttcggcgtcggtcgttcgtagagggatgatttgtttgatttcgttggttggcgggcgggcgaggatttttcgtcgcgtttttgattcgcggatacggtatatcgagtataggcggtttcgggtaggggagcgcgtttgggtcggttattcgt

SEQ ID NO: 11436 - DNA, 6511 bp, Artificial Sequence
  Description of Artificial Sequence: Synthetic polynucleotide
cgtagggtgaataggttcggttaggagtcgtagcgtcgtttatttgtatttcgtttatttggtgaggtatgtcgtggagttttaggttttcggttaggttcgcggtatttagggcgtgtgcgtggggtagtagtaggtcggagcggcggtaggtatttttgcgggcgtttatcgcgttcgtttttagttcggagaggtggggtagtaggtcggtcgggcgttcgtggtgcgagggtagtttcgtttttttttggttttggcggtcgggttaggtttgttgttggttgtttgtgggcgtcggttggtgtagggggttgatggcggcggcgtacgttttttttagatgcgagtaggggtcggtcgattgggagtaggttagttgttggtagggagggggaaagtagggtggcggttgatattcggcgattttagtgtgggagaggggtggcgcggggttgtagaggtgttgttcggcggaggagaggtgggggattcgcggatttttattgttgttttcgtcgtggcgattttggagggaaaaaaaaaaataggagatttcgttagtgcgaaatttcgttattgcgaattggtcggtatcgtcgggttacgtagagggtttcgggggattaatcgtatttcgttcggcggggtttgtttagggtcggaaggtattcgggggtaatgcgtttcgaggatttcgttgtaagtaaagagtgcggggagggaggagagtttggtgaaagatttgggggaacgagtttttaaagttcggcggcgaaggtttaggcgttgtttttaagttcgaggcgtttggaggcgttaagttcgaattttgggttttgggttagaaaagttcgtggtcggagttcggggcgaaggagttagagttcggggcgaaggagtcggacgttcggtgtagagttatttcgtggagttcgtttatgacgtagggattgttggaggtggtagcgcggtaggcgcggatagagtgcgcggcgcgggaaatgcgtatttttttcgttttcgggatttttttttttacgttttcgggataaagattttcgagcgggcggcgttcggaaagtagggttcgttattttgcgtcgttttgggaagtgaagagggagcgcgcgtatagggcggttttttttgttggtcgggtttagtcgaggggagtaataagtgggggcgttttgtattgttaagggtagtgttttcgtacgtcggggcgtagagggggtatgaagaattttggaaattgggtagttttgttcgcgtacgttttttcgtttttgggcggttcgatttagtttttaaaggatgcgtttttatttgtttaggggtttcggggcgtcgggaatttggaggaatatggcgttgtcgttttttggcggaagcgttcgggtttgcgggtaggggtagttttttagggttcggaggcgtagtgaattttcgcgagttcgtagttcgagtttcgcgttttcggcgtttttgagttcgtttagcgttgtttgcgtttttttttttttttcgttcgtcgtttttttttttttttttatttttcgaaattttagtttaatttgttcgataggttggagtattcgcgagtttttacggttttatttggtttcgggtatttttattattattttttagtttttattttttttgaaagttaaatttcggttgttttcgtgttttttcgaggaggtagcggggtaggtgataagtcggttttggaggagtgttcgttaaggtgtcgttagtaggtagttttatttgatttttttggatagagatttcgtgcgtaaaagttacgtttgagggttgtagacggggtattttttcgagaaaacgggaagtagggttgtttgtcgtttaggaaagcgttcggtaagttgtgtgggtgggatttgttattttttttttaggtttcgttttcgaggggaggttatttaggaaaaggttttatataggaaaggggtttcgtagaaatggattaaggggtgttcggagaagtggatttcgttttatcgagaggttagggtttttatgttttcgttttcgatttcggtttagtggtttttgtttttcggattgttttcggcggggcggggttgtatttcggagttttagtttatttcgtagtttttttcgtatttgatattatcggttattttttataatatggcgttcggcgttttttaaaatagtcgttagttaaatttaggatttttttagtttttaagcggtaaatttaaaatcggggttacggtgattaggcgtttgtcgtcgttttcgtcgcgcgcgggttttgttgttcgggttattggatacgtatcggcggttttgcgagcgtagatgttgtcgtcgcgagtgttaagatcgtttcgcggacggggaaagtcgcgttcgaatagtgtgttttggcgatagtcgggggattcgagcgttttaatgagaaggaaattattataattttttttcgggggtcggcgcggaggtttaggcgtcgggcggggcggtttttagttagttttagtttagtttcgtttcgtattcgggtttggcgtagcgtcgagttttacgttgtgagggacgaagcgcggagttagtgggcggtgtttcgttgatagtcgaagatttgcgaggtttgggtttttcgacgcgttttttttttgttatttttatcgtaaatatatttgagattggtagagttgggggaagggatttaaatattgaaatttatttttttttcgtttaaacggtttttattcgtttttttaaaagacggatgttatttggagttaagaaattgcgtatttggggagcgatttaataatcggggtttttttattttttaaaaatatattttattttatttatattttattgaggtttaaggtttgagttgggattatgtagttggagttttagtgcgttagagacgtttagtttttttcgtgggtatagcgcggtttcggttttcgggcgggaggagagaggaagggatttttggggagtttgttttaagggtcgtagaggtagtagacggttttattcgtttaggagttgcggatagcggcgtttcgtcgttgtcgttcgaagtggtatttttcgcggttggttgaggttagggggaattcgcgcgtattggattagtttagcggttcggttttgttttgttttgcggaacgtcggttttgtagttgtttttggcgggtcggttatttagaagtttttattcgttttgggaaagaagcgtcgggtaggaataaaattcgagcgttacgggtaaggtgagggtgaggaggtgtaggaagttgggagagagtttgtagagagttttcgattggagaggtagatatttaggttttatatgtttagatagaaaacgaaatttttttttatataaacgttgtttttttttttttttcggtatttgttatttaaatttgaaagtaaagtgtaatattaatttttaaaatttaaattaacgaaattttttggtttagttattatgtagtaattgatttttattgtaaggggaatatcgttaattttcgagggcgtatttgttgggacgttttaattggttttttgggttggatttaaatattttgtggggattagaggataagattatttttatttgatattgaatacgattttgtaataattaatgtttattagtacggtgttcgtatttgtagtagatatgatttttttatttacggaatggcggtatttattgtttcgttgttttttttcgggttcgtttgaattttagtatttatttagatttaggtgggtttaaaagaaaataataataataggcgttttttaagggaaattttttttcggttttagatagtagttaaattttaggtgatttttcgatcggacgcgggaataaaatttggaagttgaaattattgagatttttcggttaagtatatttgtagggttttgtattaaggagaatagtgtataaaaagatatataggattttgatatttcggttttaaaataggtttttgggggtaaaataagttatcgtagaagtagcgtttttggtattagcggcgggggagggggatatttgttagaagtagaaattagatttaggttcgtaggtattttagagtataggtttaggaagatgggttttagattcgttagaggtgcggcgtttttttcgggcgtttgggattttttgacgggtgtcgttgggttgttcgatattttgggttttttagttttcggttttattttttgattcggtttgaggtgtagtttgaataagttgttttgtttgtgttggtaagtttattttttgtacgttggggttcggaatgggtaagaaggtgtttattttttattttaggttttggttttttttttttatagtaatattagttaaagttgttcggaggaatcgatatgttttttcgtttgggagcgtttacgtaggaggcgaagggagtcgatgggtattgagggttcgcgtagtatcgtgtcgtgggtttaaaggatttagaggattcggaatcgtttggtaaaggttatttatttttaaggagtttttttggatttcggcgttgttttttttttaatgggtaagcgttcgaattggagcgtaattttcgcgttttttgtacggaaggtagttagaataaattttttgttttttcggtacgggagatttttttttaatacgtatattttcggtttttgggtcggtatttaggtacgcgcgcgtttttgtgaggaagttttaatttttttttgattttaatttttttgtttagtagagtcgggaatcgaaggttttagtatttaagatagtttttttttaacgttttcgttttttgtttacgtgaagacgcggattgcgtggtcgcgtttaagatagtcggtatcggtagaaggggatttttttggaatttcggaggtttcgtagtcgtttggagaagaggatggaaggttgtcgggggtttttttttatcgttttttagggagtttaaatttatttattttttggaagttttggatttacgtttttatgaaatcgtaaattaggtttttgtaatagcgggagcgttttaatagcgcgttatttttaaagaggcgcgaggtggtgtttttggaaatagggttttcggttttaggtttgagttattcgttatttttgtttttattttagacggaagaaggcggttaggcgggtagagtaagattcgggtagatttgcgattttttttttcgttttagggaggggattttcgagtagaagatggaggttttcgagcgttttcgtagatttcgcgttacgcgtcggacgtttgtttcgtttttcgggataacgtgagcgtcggtagggattttagtaagtggtagattcgttaggattaagtaaggtggaaaggtcggggtttgcggtaaatttaggaggagggggtatttacgttcgttatttttttttcgcggtattggtatttattggatcgatattggcgttaaagggtattttgaagtatttatgtttagtaagggtatgttttggggtattatagatattaagttatagttattttaaaataattataaaaatgattatcgtaaataatagattgttttaatagggcgcgaagcggtcgtcgtatatagacgtttttggttttagttttattagatttagtttattgttcgtttttttgcgtttcgcgttaggtcgtatgtttttcgtttagaattttttgagttttaatttttttttttaaataatttttttttttaaataggtaaagtgaggcgaggagttgaggggtttataggtttttaagttttcgaggagggttcgggtttacgttagtttcggttcgttaaacgagatttcgtgggtatagtttttaatttgataattatttgttttattttatagtaggtaaaagtgaatttttagtcgtttaattatttgaaagttataaaggtgtttagggttgaaggttatttttttagcggttttattagggagttcgttagagatatgtttgattttttttttgttttgtttcgggggggattttcgttcgtcggaggttttatacgtttggtcgtgggatggtagatttttgttatttttttattaatatttcggagtttattcgtacgtattttaatcgttcggagcgtaggttcgaggattaaggcggtagtttcgtgttttttgaggtttttttcgtttcgtgttttgggtcgttatatatttttcggttaagttcggcgtttttaatttagaatttggtcgtttttaggcgtggagtaggttattgttgttagacgttgcgcggattcgtttttttgcgttagtattgggcgataggtagttcgggtagtatttaggagttattttgtacggttttaggcgttcgttttatttagcgttatttttcgtttttcgtagcgagttttttcgtagttttttttttttgttagttttcggggtcgt

SEQ ID NO: 11437 - DNA, 6511 bp, Artificial Sequence; identical to SEQ ID NO: 11436
  Description of Artificial Sequence: Synthetic polynucleotide

SEQ ID NO: 11438 - DNA, 338 bp, Artificial Sequence
  Description of Artificial Sequence: Synthetic polynucleotide
cggaaatttttaattcgcgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcgcggtgatttcgttgcggatcggttcgcggtgattttagcgcgaacgagttggttgtcggttggggcgagaaaggtttgcggatcggtttgggcgtatgcgcggaaggcgg

SEQ ID NO: 11439 - DNA, 936 bp, Artificial Sequence
  Description of Artificial Sequence: Synthetic polynucleotide
cgtaggcgcggggtgttttgagttttttaatttttagagggaaggagtttatcgtgggggatcggttaaagttttattttttgttcggtttagggtaaatcggtttttcggtagtttagttcgtttagtttttttcgagaggatataggggattcggagttcgtaggggttagtattatttttcgtttcgggtttcgttttttatttttcgtcgtttcgagacgtttcgatttttagttcggaggtgagggtttttttttatgtacgggcgtttgatgggggtaggggtggggacgtacgagagttttaggtttcggttcggatcgttcggggttttaacgtttttttttcgggtttaggaatagcgttttcgtaggaagtatttgtttcggagggggttttcgggatgtatttcgtcgtgttcgcgttcgatgttcgtttttttagggtttcgcgatttttggggatttttcgtttttcggtttagggggtatttatttcgtacgtggagttcgggtagcgtttttagacgtatttagcgggatatcggagaggacgtcgacgtagtgtaacgtttcggtcgaagcgtcgaataatatgcgcgcgtcgcggaggaggtgcggggcgtgttcgtttaggtagcgggtcgtttcgacgtggtagaagtttaggaagtcgtagttcgcgaaggataagttttagtcgcgttttgcgtcgtatatggcggcggcggcggggcgggggcgcgggttaggatttgggtcgggatcgggaatcggttcgggttttgattcgtagtagtttcgttcggcgttcgtaagcgttttttattttgttttagtgtttcggttagggtatttttagcgcgacgttagtttcgtttttttcggattatgtaaatgagtcggcgggaggtttaatgagcgggtaggacgt

SEQ ID NO: 11440 - DNA, 2184 bp, Artificial Sequence
  Description of Artificial Sequence: Synthetic polynucleotide
cgttacgacggggattttattacgttgttttttatttacgttattcgtttaatttacgcggagggttttgagggttttattacgtagttttgaaggggtagagttggggttatataggtatcggaagtttacgttgtggttttaggagaaggttttggatgtggtttttatgagtgaagggtggatttatagcgttgtcggaataaagggaaattataggtaggagggaagcgcgtttaggattcgcggttatcggttttttagattgttttttggggttaggtcgcgaggagatggaaagcgggggtattataggttcgtttgaattcgcgcgtttattcggttatatcgattttaaatttttgtatgcgggtaggatttttggtttttttgcgtttattttagttttgttggtcgtcggggtatttgagggatggttgcggggggtcggagggtggaaggggcgtcgggtagtttcggtggggaggggaagaggtttttcgtgtattatggattttcgtattcgggaagggaggcgttcggggttggggagggaggaaaaggcggttgtgttcggggagggggtagcgagatttcgttcgggttacgggttgtaggatggagcggacgggaggaaggagttttgacgtcgcggattttacgtttgtcggtcgttttttttttttttgttttttttttttttttttttttcgtagaggtagcgcggggattcggtcggggtggggttagggcggtgcgtttcggagtttttaatttggattttatttcggaggcgtcgcgatcgcgttttcgtcgtttttaggaaggtgttcggatcgcgtcggcgatcggaggattttgcgtttcgtcgttttttattttgtttcgtttcgcgtttgtcggcgatttcgcggggtcggttttcgtttttatttgtagttcggggcgcggcgtttttgagggaagcggggttttgggatttttcggtttgggcgtgggatattttacggttcgtacgaattttggtggttcgggtttttgtttttttagaatagcgtttaggtttcggagaaatttttcgaagtcgtgggtttagacgttttcgggggatttcggtgggacgggtagggcgggcgtcgcgggcgaggggacgcgtattgttttcgggcgaattagaaatattttatatcgggtatttttttaggaatcgtttatttatttttattgttttttattaggttttattttattattttttttttaggtatttttttcgttgtatcgtttttacgcgggtatcgtttttattcgggtatttcggttttgttttgttttggggtggtcgtagttcgcggggaggaagcgcggcgaggcgtttatatcgggaaagtgttttcgtgattttgcgaggttatatttcgggtgcgtcgttgcgggttcgtgggttcgtgggttgtagtttttcgtttttgtcgggtggacgagtttcgggttcgcgtggagttgttcggttaaggtcggttcgggaggggcgcggcgtagggcgggtaggggcggggttttaggttaacgtttagttttagatttagtttcgtcgtcggatttatcgtgtttttgtttttttatttttgagaaatcggaacgtcggcggtattttttttttcgggtcggagtttgcgtttttcggattgcgcgtttttgtttaggcggcggtcgggggtgggagcgcgtagcgggttaatttttttaaagggaattgtcgggagggcgtttagaagggaaagattaggaagcgttgggtgttgagttggagtttggtttttttttgggggatcggggagggggttgaaggtggggagaagatcgtcggggttgttaggggggtattgagggagcgtttagggggagaattttgggtgggcgacgtcgtaggggagttgtttggtaggggcgagggtttcggggaagtggagtttttggtcgagagttgtatttgtggtcggggagggaaagggttataagggtagtgcgcgtcgggagggaagtttaggtcggggggaagggattgcgcggcggggataggtgcgtcgggtgttggatagtgagtaggagttcgtcggtgtttaggttacgaaggtgttggagtcgggggagttggaacgtaagggggttaagggaacgcgt

SEQ ID NO: 11441 - DNA, 413 bp, Artificial Sequence
  Description of Artificial Sequence: Synthetic polynucleotide
cggtttgacggcggggtcgagtaggggaagtggaaggatggagggagaaagggagagagttttagtcgtttcggttgtggtaggaggagttttaagagcgtttttcgagttcgtttcgtatttttaggtttagttcggcgtaggttttttttttcgttttttttattttcgttagttgttgaaatttttttatcgttttttcgcgggtaatagtgttcgttaggcgtcgtcgcgcggtgtttcgttttttacgtcgttcgttcggaaagagttcgtagtggttcggggcgtcgcgttttgatcgacgtttttggggtttgggagggcggcgttgagagttgggagaggcgttgagtttttcggtttttacgggacgtcgggaaaggagagcgagcgtaatttttacgtttcgg

SEQ ID NO: 11442 - DNA, 403 bp, Artificial Sequence
  Description of Artificial Sequence: Synthetic polynucleotide
cggttcgcgtcgtcgtgttttttattcggttatatagcgattttaaaagtttagtttttatttcgcggagatttcgatagttttgggaggttttttttaaaagggaatttggagaaatttgttgttgagtacgattgagttttattttataaaatatttattatttcgtcgttattttttaagtttacgtttttaaatatgcgaattttaaggtttagttcgggagtaagttaattttaggattcggtttatcggcgcgtgttttgaaaagaatgtcggaggttagatttttttttatcgtttagaggtttcggtttagcgtatatatttggggttcgtagggttttcgcgcgtcggaattcgatttgcgttggattttttttcgggcgtaggagttaagcga

SEQ ID NO: 11443 - DNA, 675 bp, Artificial Sequence
  Description of Artificial Sequence: Synthetic polynucleotide
cgttttatcgtattttagtggagtgtcgcgaagttgtaattcggttttaaggcggttcgtatttttattcgtatataaaggtaggtcgtagtttcgtacgcggggatagggttagtaaggggcggggattttcggggtcgtcgttttcgtagtttcgcgtgtgggattttggggcgggtcgttattttgtggtgcggtcgtcgtttgttaggagatatttagtaatttcgtagcggttattttttataagaaattttcgttgtaatcgttgcgttatattatcgcgttttttagggataggaaagttttttcgtgtttggtgaagttttaggggaagtagttattttgtcgtcgtatacggtaaaattttttattgtcgtagtcgttcggttgacgtgataagggaggtgtaggttaatacggcgatttcgcgttttttggcggtagtgtcggagtagcggcgttgtttttgatttattcggtattcggttttcgggatcgtttggcggttgtgaatgtagagttggggcgacgtggggttcgttttttgggattgggtgtgagtttgcgtagtgagttatatgggggttatggtttggcgtgggggcgtggtcgggtggggtcgttggatttggtgttggaaagttagggaagtagtcgtgcgtttaagaacgg

SEQ ID NO: 11444 - DNA, 580 bp, Artificial Sequence
  Description of Artificial Sequence: Synthetic polynucleotide
cgaagagttcggttaataaagtaaacgtttcgttttcggttttttttttttttgtaggggaaacgaattgaacgtttgaaacgaaggtggcgcggtttggataaatttgatttttcgatatttttcgtttttgcgttcgttttcgttaagcggggaggagcgatcgttataatggattttttcgtaggttttgtgcgcgttgggaatttagttgtcgtcgtttcgtagagttttttgttttcggagggcgtttattttcgggtcgtttattattcgcgtagtatcggtagtcgttgtttcggtagtttttagtcgtttcgttcgtttgtggttaattggttttagttatttttcgaaatgttagtcgattttattgggtattggaagatgttggttaacgagaatttcgaggagtatttgcgcgttttcggtaagcgttgttcgttgcgttttgggcgtttcgtcgagtagtttcgggtcgttttttagagttttttcgagacgttgtttgtttgtttttatttcggcgagtcgcggttcggtgttttcggacgttagaaagggcgttttcggttatcgt

SEQ ID NO: 11445 - DNA, 858 bp, Artificial Sequence
  Description of Artificial Sequence: Synthetic polynucleotide
cgggaatatcgttttttcgttagattttcggcggtttttttttttttttttaaatttatttttaaagttaagtgtaggttttttcgttttagttagaagcgttgcgtgagtttttatacgtagtcgtaggtagttttttaaatagcgttcgcgttgagtaaatagtttagacgtggggtttaggagggcgagttgaggcgatcgtatcgggcgcgtagcggcggcgggttagtcggcggttaatagttagggcgcggttcgtttcgtcgttttttttcggggagtttataaggttttcgtagcgtttcgggcgtttgttgtttcgtgtttttatcgacgattttatttagttgcgttacgcgtcgtttcggttgtcggtcgcgcgttttgttcgtcggttttcgttcgtaatcggcggtttagggcggattcgggtttttgcgttttcgcgagaagcgcggcgttgcggggtcgtgggcgtttgagttcgcgcggttttcgagggtcgaatatggggggatgtacggtgaagttttagttgttgtttttggcgttcgttttttatttttggaatttttgtttgggtgcggattcggagaagttttcgagtatttttataggtgagtatttcgcggttcgtcgttgtttcgcgaggttcggtcggcgggggggtagtttatttatttattagttttttcgcggggttggttaggtgagtagtgggggtttgttttttttttttaggatcgtcggggttttttttagaattgcggtcgggcggcgttggtttttggggaagtgtaggggtattcgttttcgttgattttttggagttttcggtgaatttagcgtgttcga

SEQ ID NO: 11446 - DNA, 5715 bp, Artificial Sequence
  Description of Artificial Sequence: Synthetic polynucleotide
cgttcgtatcgcgtatataggtagtggacgttcgtttatttgttcgtttgttgggcgtagggcgtttttggggtggggagggcgtttttgtggggggaaaaggggcgtttttgtttcggagggggaaaggacgtttttgtggaaggaagggggggtttttgaagcggtgtggtgagaggacgttttcgaggaaggaagggggtgtttttgtagcggtggggggagaggacgtttttgcggaaggaaggcggcgtttttgcgggggttggagagacgttcgcgcggtttttcggtttagggatcgttggttcgcgggttcgtttttttttcggcgttatggaaatcgtatttttttcgtttgtcgttttcgattttttttttttattattttttaaacgcgattttaatttttcgataagttgataagtgaatggcgtagaggacgtttcgtaaagcgttcgcgagcgggtgggatataggcgtttttttcgcgtttttttgttttttacggaagggcgcgcgtcgttttcgatttggagcgcggtgttcgcgaattcgcggtcgcgggttttggaattttttcgcgtttcgcggttgcggggggacggagatgcggtcgggagacggggacgggaaacgggggacggggatggggcgcgtttatttcgagcgcgggagcggtcgttttcgtttaaaatggggatttcgcgtttcgagagtacggttcggttcgtcgtttatgtttttattgtaaggtcgtagttttcgtcgtcgatttcgatttttcgtttcgtttagtcgcggtttcgttcggcgtttttttttcggtggaagtttaagtttaattaattgagttcgaggcgggagggaagggttttgcgcgtcgtggttcgtttcgtttttttttcgcgttttttttttcgttttgggtggtatttttttcgtcggtatttataataagtcgttgattaatgaggtcggggtcgttttatttcgttcggtcgggtcggggttttcgcgggagggggaggggacggcgggaaacgcggttcggggagaaaggggggcggggcgggggcgcgcggttcgttttcgcgagcgtcgcgtcgattggtcgagcgcgtcgttcgtcggggggcgcggcgttaatgcgaggtagcggggcggggcggtcgcgttgtgtgtgtttgcgtaacgtcgagttatatgttgttttgttttttttagtttagttattcggtgcgcgatgtgttatttattgtgcggcggggatcgcgacgagttcgggtcgtcgttggtagtagtagtagtaatattagtagtagtagtagtttcggcggcggcgcggatttcgagcgttcgggcgtatttcggtttttcggagcgcgacgcggcggtagtagtttcggtgcggtcgcgcgcgttttaggttcggtttcgcggttcggggatttcgattttcggtttagcgagcgcgtttttcggcgtcgttcgagagttcgaggaggtagcggtcgtaggtagtcggggaggggggcggttatcgttcgcgtcgggtatttttaggagttttagagcgcggagggcgcggcgtcgtcgagcggtgttggttttcgcgggttttttcggattttttttatcgtttgggttcgagggacgcgtgatcgggcgggcggtcgggcgtaagggtgggagggagtcgttttcgttcgcgtttttttcgtttttcgttttaatttttgggcgtcgggttcgggtcgcgcggtttgaagcgttcgcgatggcgagttcgtcgcggtacgggtcgttcgggtcggcgagcggagacggttttaattttaataataataataataataataattatagcgtgcgtaagtgcggttatttgcgtaagtagaagtatggttataagcgttttttcgtgttgcgcggattcggcgcgggcggcgacgaggcgacggcgggcggggggtcggcgtcgtaatcgtcgcggttcgagtattacgagagcgagaaaaagtggcggagtaaggtaggcgcgtcgaaacgggtgatcgttttcgattgttgtttgaatattaataagcgcgtcgacgttaagtataagtatttgatcgttttttatattaaggacgagtatttcgtcgtggtcgtcgagaacgagtaggagtaggagggttggtatcgcgcgtttatcgatttggttagcgagggtcgcgcggtcgtcggagacgcgtttttcgtcgtcgcgttcgtcgcgttttgtagcgtttttttgttcggcgttttgggcggttttgtcggcgtcgtcggggtcgaggatagttacgggttggtggttttcgttacggtcgtttatcgtgaggtgtggtaggtgaatttgaagtttaagggtttgggttagagtaagaatttgacgggggtgtatcgtttgtgtttgtttgcgcgtattatcggtttcgtgaagtttaattgcgagtagtcgtcggtgacgttgtagtttatgaatattcgtcgttgcggttattcggatagttttttttttatcgaggtgggtcgttcggtcgttataggtttcggcgagttgtggatgtaggcggacgattcggtggtggcgtagaatatttacgagattattttggaggttatgaaggcgtttaaggagtttttcgagtttcggtcgcgtagtaagagttaatcgtcggggtcgtcggttacgtattttattagcgttttcggcgcgcgtcgttattattatttggttaatttgttttttagttagacgggtttggtgcgtcgttcgcgtatcgatagtttggtcgttatttcgtcggcggttaagtgtagttcgtgtcgggtgcgtatcgttagcgagggcgacggcggcgcggcggcgggagcggcggtcgcgggcgttaggtcggtgtcggtggttgggagttttttgagtttcgggtcggtgcgcgcgtttttgagtcgttcgtatattttgagcggcggttgcggcggtcgcgggagtaaggtggcgttgttgtcggtagggggcgcgttgtaatatagtcgttttatgtttatgttcgtggcgtattcgtcgttcgtcgttattagtttcggttttttgtcgtttagtagcggttacggttcgggtttttattcgtcgtcgttcggttcgtattcgtttttgtcgtattcgttgtattacggtttcggttagcggttttttagcggtagcgttttcgtttcgggtttttttagcgatttcggttttatgtttttggacgagtacggttttagtttaggcgatttgcgcgttttttgtagttatcgaagtaatacgttcgagtttatcgcggagacgttttcggttcgagacggcggcggcggcggtgagttttacgggtatatgattatggataggtttttgagttattgtggtcgtttttatcgtcgggtttcgggggacgcggtttaggatttggatcgagggttgcgtaagaggatttattttttgattacgttagttcggtagcggtcggtgttttagtttttttttgtttcgttggatgaatatattttgatgcgggttattttttcgggtagcgcgggtcgtttttgttcgttttgtttcgcgtttttttttaaggtggtttattatttttatttagaggattacggagatatcgagatcggtttttataggagttttagtagtaatttgggggtagacgacggttatatgtttatgacgttcggcgcggttttcgcgggtagtgggagcggtagttgtaggagcgacgattatatgtttatgagtttcgttagcgtgttcgtttttaagtagattttgtagtttagggtcgtcgtcgtcgtcgtcgtcgtcgtgttttttgcggggtttgcggggttagtatttatttttgcggcgggtaggatattttcggcgagcgggggcggttataaggttagttcgttcgtcgagagttttttcgaggatagtgggtatatgcgtatgtggtgcggttttaagttgtttatggagtatgtagatggtaagttgttgtttaacggggattattttaacgtgttttttagcgacgcggttattacgggtatttcgttcgatttttttttcgtagttttgtatttcggcggggagtcgtttaggggcgttttcggttgttgttatagttttttgtttcgtttttataaggttttttatatttgtggcggggatagcgattagtacgtgtttatgagttttttcgtggggcgtattttggaggaggagcgtttggagttttaggttacgttagggtttagttaggcggttagcgttttcggggtcggttttacgtagtttttttattttgtagtgttttcgttcgtgcggtttagcggcggtcgttcggagggttttttgggttagcgcggtcgggcggtgaggtttacgcgtttgtttttggaggggttgtttagtttgtttagtatgtacgagtatttattgttatcggagtttaagagtttcggcgagtatattaatatcgattttggcgagttcggggttcgtttgtcgtcgttcgcgttttttttgttggcgtcggcggtttcgtttttttcgtttttgttcgttagtagttcggtttcgtcgttgggtttaggtatttcgggtattagtagcgatagtcggtagcggttttcgtttttcgattatatgaatttcgattttagtttttttaagttttttaagtcgggcgtttcgagcggttatttcgtgggttttttggacggttttttgtttttcgaggtttttttttcgtattcgtcgttgttttcgcgttcgttcgcgttttcgtcgtcgtttttgtagtcgtcgttatcgtcgtcggtttcgggggagttgtatcgtttgtttttcgtttcggtcgttgttatcgtttagggttcgggcgtcgttttatcgttgttttcggatatcggggataatggtgattatatcgagatggtttttggtgtggtcgttatttcgtcgtaatttatcgcggttttttcgaagttagaagttgttcgcgtggttagttcgacgtcgggcgtgaagaggttgagttttatggagtaggtgtcgggagtcgaggtttttttgtaggttagttagttttcggatttttatcgcggcgttaaggttattcgcgtagattcgtaggggggtcgtcgtcgttatagtttcgagatttttttttttattacgacggttattttcgtgttttcgtttttcgtttataattttaagcgttataattcggttttcgtggaaaatgttttttttaggaaaagtagcgagggcggcgtgggtgtcggttttggagggggcgacgagtcgtttatttttttacgatagttgtagtcggcgttttttttggtatcgtagggtcggtcgtggatttcgggttagttcgggggtttggtcggttgttttgggagcggtggatcgtttatgcgtagagagatttttgtcggtttttagaatggttttaattatatcgttatcgacgtgagggaggagttcgggttgttattttagtcgtagtcgtcgtcgtcgtcgtttttttagtcgggagataagagtttttggggtcggattcgaagtttcgggggttttattagcgttgtgggcgtcggtagtatcggcggcgggtgcggggggtcgggtttcgg

SEQ ID NO: 11447 - DNA, 858 bp, Artificial Sequence; identical to SEQ ID NO: 11445
  Description of Artificial Sequence: Synthetic polynucleotide

SEQ ID NO: 11448 - DNA, 247 bp, Artificial Sequence
  Description of Artificial Sequence: Synthetic polynucleotide
cgggtattgtttgtcgttagtataacgaagaaatttatatttacgaagattttagattttacgtgattatattatttaattattagcgttggtttggaggaattcgttgttacgtgatcgttcgtgtttaatgatcgaggtttacgttttttagatcgttatagtcgttgttatagggtttgagtttgggcggcgtttcgtttcggtcgtacggtgcgtcggcgttaatttttttcgaaggtttcgg

SEQ ID NO: 11449 - DNA, 224 bp, Artificial Sequence
  Description of Artificial Sequence: Synthetic polynucleotide
cgtcgttaagaaggaggaggagcggtaggaggcgttgcgttaggcggaggaggagcgtaaggttaagtacgttaagatggaggcggagcgcgaggtcgtgcgttagggtattcgagataaggtgcgcgtcgggtcggtttcgtttgcgggaaggcggttttgagtttagcggggatttagatttcgtttgggtggaaggggttgttcggaagaggggcgggcgt

SEQ ID NO: 11450 - DNA, 1174 bp, Artificial Sequence
  Description of Artificial Sequence: Synthetic polynucleotide
cgatgtggcggggtttgggaaatgcgttcgttggagtatatcgtagtttcgcgggttttcgagcggcgcgcgcgggtcgaggatttttagggtttttcgcgggtttttcgagcgtcgtcgtatcgtttttgttcgcgttcgggatcgtttcgtgggtttttttgttagggtcgtttgcgtcgagaggtagtttaggttttgtcggggacgtacgggttttatttttgattttttagtcggagttttttgaggatttgtaagtatataggttggagtcgagaggttaaattaggttttaggggatttttttaataaaattttaaattttatttaggttgttcgtaggttaagcgattgtaaggattttgagtcgaagtagcggtgtcgggtcgattcgaggttcgttttttatcgtttttttttcgggtcggttttgtgtagttggggttttggaattcggtttttttcgggttgtcggttttggggtttggtgttcgttatttttttttttcggaggtcgttattgtttttttattttatttttagttttttcgtttttttttacgtttttttttcgcgtttttttttatttgaattttttttttttttcggttggaagaaaagtcggtaatgagaaattagtttagtgttagtcggaggaggggggtagataattttagagatatacggtaatggagagagaatttattttgtgtaaagagggtttcgagttattagggaatttttggattgttttaggttgtcgtgtgtgatgtttattacgtcgtgcgaatattatttgttcggtattgtgtttttagttgttaggttatttgttgtacgtagtaatatttgattgtttggttttacgttcgtagcgttcgtttagacgcgcggggcgggggtcgcggaggggcgggcgggagttttgattaagttatttgcgaggggagggggcgcgggcgtagcggcggtcgggtacgaggtcgggttgatattattatttgttggggcgcgggaagaacggtagttgttttgcgttgtttcggcgagggacgtttggaaaaggttgaagttttgggcgtttttaagttcgttatttacggggttttcgttattttagtttgttcgtcgtcggtcgttttttgtgattttttgttttttggttcgtcgt

SEQ ID NO: 11451 - DNA, 8657 bp, Artificial Sequence
  Description of Artificial Sequence: Synthetic polynucleotide
cgagacgcgtcgattttttcgggaagcgcgagcgcgcgcgtgtttgcgtttttgtgcggatttgggtttgtcgtgcgcgtgtgtgtaaaggtgaaacggcggcggagttttaaatattttattttcgaattattttttgttgaggaattaaggttgttaggtcgttgttgattttgaagagggttttttttaattgcgatttttttaaggaattcggttttgtttatttttaaggaatgttttttttttttattttttagacgttgtaggtttttcgcgttgcgtttttttttaggttggagtcgtagttggcgggacgcgtcgtttttacggtatgtcgggtgagagtcgtttacgagcggtttagcgtggcggatttcggttttgagtcgcgcggacgtttggttacgaggggttttcgattcgggcggggagaggtgcgatttggggggagggggcggggcgcgtaggaaggaggaggagagagaaaagggcgaagttagcgcgagattaggaaggagaggagggtagagacggagtcggcgagatgttggagaatttaggattgtgggtattttgagcgggagagaaattttaggaagtacgtcggaggcggggtatttgtgggaggaaggtaaattttgtagagcgttaaaggatgtcgggagggataagttagttatggggagattttttagaaattcggagttgaaaatagggtagttaagtaagtaagagttggttagttgaatacgaggtttttagaatgtaaattataaataagaaagaaagaaacgaaagaaaaagaaaagagcgcgcgtagggtttcgggtttaggcgtttagagtagttcgtgcgggggttttttcggtttatagtagtcgtcgtttcgcgtttttgaagtggcgttcgcgtggttattcggggattttttaggtttcgggggtttatttgaaaatttcgagaggttttgtatattttgttaggattggagttgcggggattttttagttttttacggatgtttttttgtacgtgttttttaggaaaatatttaggtttcggaagcgtttttgagagtttagaaatgtcggttgagcgtgaaatttagtttaatttatttatagagtattagatttagaaacgacgtttgaaagagatgtgggttttatgttgatttaaattttgttttatttataataacgtttttgtttttaaagaaaagaaaaattttttagttaaattttttatgttttcggttttttgtttttgtttcgttttttttttcgataaacgcggggagttttggaacgggagggtcggtgatcgcgaatacggtagcgatgtgatttgatgtattgaaattatttatatttttaatgttattttattaaaggaaatttatataaaagcgtttgttttattttaattgttaaaaaagtttgttatattttcgaacggtaattgttttttcgttagatatcgaaagtttataaggaattataatgagaaaggattaggagtcgtttaggttttattgaaatgtttcgatgtcgtttttttttttttttcgaattaagtcgtcgggggaggaggtgggtcgcgtttatcgttgtcgggattcgggtcggtagatacgggttatagcgttttttcgtcgttcgcgcgtacgatttttggtttgcgtcgttttttttcgttttcgcgatacggaggacggcgtcgcgttcggcgagcgtttcggtttttttagtcggtcgcgttttcggggagatttcgagttcgagttttcggggtcggttgtttttcgcgttcggtttcgtaggaaattttcgttcgttgaaatttgcgtgtttacgtagattcgttttaaattttttggttgttgtagggataataaagaaaaatagaaatagtgttaattttttttttattttttagggtatatttaggaaagggggtagggtttattaggaatttgaaattgtttttatcgtttgggttattgtgattaggggtcgcgtttgtaaagtagttattgggttttttttgcgtgtttgtttatttttttttttttgttcggacggtaattgaaaagttttagaagttaagtgtcgggttttttttagcgattttataggtttgagtatttcgtttcgtttttgagtaaaatattttaggttttttttttcgggagtcgcggttttgtagttttcgtggtttcgagacggagtttgggttgagttcgttatttttttaggtagtttcgtcgggatcgtcgcgttaagattttacgttggtagtatgtttttttatgattgattttttttttttttaagaagaagattaagttaattttaatttaagaagaaggaatgtgatttttttttttaatattagagagttttaaagtaaaacgtagtttatatattttaataataatgacgagtgttaagtttttaatgtttttgcgtaggtattttaatttgttatagttattattaataaaaacggtatgtagtaagagtcgattgtttaatagtgtaaggtagacggtttttattagtaataggtagtagcggtatggaatatatagattttagtggaggagtataattgttaaggggaaaatatatataggacgggaagaggttatttttaaatttttaatattgagttaaagagggggaagggtaggcggcgtttttggagatgtattttgggtgaggggatttttttcgttattgtacgtgtttggttatatatttaattgatgttagaatcgattgtatttagagtagatattttagttttaaattgaggatgtttgtataataattggttgtttttttttttgtttttggtagaggttcggcggggggaggggggtgggttaagggagggggagggaggatgagttttaaatgttaatgaaattatagcgggaatcgttttttagaaatggaaatattttaggttagtgttttttggtgataaaaattatattcgattttttttttatttaaattgatttgatcgtaaaggaattttaaaggttgttatttgatttgatagtgtttgtgtttgttatttagcgtgtgggttttttatttatttttttttttggaggaatttttttttaggaagcgtaaaaatgtcgtagattgtcgacggtttgtttaattcggttgttttttttttttttttgttttttagttttatagtaattgattaaaaatatttgttttggattgaattaggatgttttatgtggagtcgtaataaggttgaaatttttcgttgggtcgttgtagggggtttagtttgtgggaacggggtgtttgtgggtggagggagaggtggtcgtgggtgtgtgtgcgtgtgcgtgtgttgagatggtttgaagaggatgtgtgtaggatgggggtgtggtttgtaggaagagtggtgggggagtagtgtgggcgaaggggtgggtgggataattggtagggggcgagtggttcggttcgggagtttttggcgggaggggtaacgtgtttggatcgcgtttatcgggagtttgtcggtttaggaggagttatttttaagtatagtattgtagtttgtaattggtttttttgtatttggggaaagatagtttgatgtcgtgagtgttttttttgcgttttggattagattggtaattcgggtttcgtttttttcgcgtcgttgtagtcgtattatagggaggtcgtaatatgttttgcgttttgagattattaaggttgtttcgtaggttgtagggttagtaggggtgtaggagtcggttgtaggtttgagttgaggttcgttttaggttattgcgtttttttttttttatcgtatttattcgagacggttttcgaggatagaggtatttgttgggtgggtgtttttaataggttagtatagatttgatatttttttatttttttgagcgttttttataggtgatttttcggagtgggtagttagacgtttttttcggttattttcgagtggaaaagggttggagaagcgtgatggggagagggttttaggaagttggggttttaggaattttcgttaatcgtttcgtttttgagtttcgtaaggtaatcgtttttttattttagtcgcgcgttatttgagttatttgtaatgtttattgtatcggcggcgttaatttgagtttttgttcgttttcgacgtgattgggaggttttaggttttgttagaggcggtttgttaggtaataattatttttttagtgttttgataatataaatttgaaagaggagttaatttagaaaaataaaataaaataaaattttttaggggacggcgtttttttagttgaagttttggcgttatttttaatagtggaaagtcgtaacgtttagggtttcgggggttgcgttgcggatttgggggtagaaagtttattttagggtttttttggtaattcgtaattaaggcgtttcggatttaggtttatgttgggcggagtggatcgcgaggggtaggcgattagacgcgaggttacgcggggagtttcgggttaggaggtagagtaggttcgggatcgtggaagtgagagtcgcgcgtattgttcggaggaagattcgagtcgcgggcgttattattttgatttttttatttttttgcgattttcggattggatataggggtcgggttttttcggggtgtatagcggggtaggttgtgagttttttaattggattcggtttggtttgatcgcgggcggtttttgtttagtttgtgagggtggagaagggggtgggggcggggtagtggttggaaggggcgggggtcgggtaggggcgaagacggtggtcggggacggtgggagtcggtcggagtcgggtaggggacgtggtttcgagtggatgggagtgggaggggtgcgcgtcggggtacgtagcgcggtcgggttgggttgtaggttcgcgagtcgcgggttggggtcggagttgttagagaggcggttgcgttataaaagtttgtcggtttttttcgtcgttcgttttcgtcgttttcgttttttttcgtttttttttcgtttttttgttttttttttggtcgcggttcggaggttgtagcgggcggagtaggggaggggcgggttttcgaatatgtagatgagcgcgtgatggatagttgcgcgttttaatgtttttcggaaattcgagcgttttttttttaattttttattttcgattttagatttttttaaatttcgatcgtcggtttggcgcgcggttgcgtttatcggtttcgcgttgttgtcgtcgttatcgttatttcgtcgtcgtttcggttcgcgggtcgtttaggttagtattcgggtcggtttgttttcgtcggtcgttcgggtgttcgtcgtcgcgtcgcgtttcggtcgggcgtggatggagggcgtcgcgcgttttgttcgttgttcggcgtgacgcgggtttcgcgtttcgcgtttattatgttttattcgtagggttatttgtattaggcgttcggttcgttggcgttttattcgtgttcggtttacggcgcgtcggttttggcggtttcgcgtagcgaggagttggcgcgttcggcgtcgggttcggcgtttagtttttattcgggttcggcggtttttacggcgtaggcggttatcggtttcgggagttcgttgtagtattcggtcgacgtcgtcgtcgtcgtcgtcggtttttcgttttatatggtaatcgggcgcgggcgggacgcgggatttttgggcgtcgggatttagacggggtttaggcggagcggggttcgggttcggcgggcgggggtcgtcgggaatgtggcgcggttggcgatttaggagtcgtcggttcggttggtcgtttcgtaggttgagtcgggtttcgggtggggagggtagcgcggtaggcggggacgtttttgagttcggtcgggattcgcgcgtttttcgcgcgttttttcggttcgtcggttgattttttttgagagtttgggaagtgcgttttcgtcggggtcggggtttggcgtcgtttgtttttggttttcgtatcgtagtttggggaggcgttcggagcgggttgtgtgttcgtttgtattggcgtggggcgcgagggttcgcgttattgcggtttttgagtcgacggtcgggcggttcgtatttattcgcggggtttagggcggtgggggttatcgagttaggtttaggagtcgagtatttagttgcggtttcggagttcggttcgaggcgtttaggtttcggttttattttgtttagcggattatgtttttaaatatcgtgtttgcgggcgcgtgattcgttaagggtcgtttgagtttttcgtggttcgagcgtagtttttgtttcggcgatttgggggcggttcgcgagtttcgaggttattgagttgggttaggttcgggtcgcggcgaagtacgttacgggcgattgaggttattacggggttgtcgcgattgtcggttttcggcggaatttttgggtagcgatcgagtcgttggggttttggcgaaggttgtaaatgtttcgaatttaaacgttaaaggatgaattaaaatgttaattacggcgtatttgaagaattcgaaacggtgattggtttttgagttgtaaattggatttgtttagttttagagtagtgaatagtgaattgggggttttggggtgtttttttaattatataagggaggggaagagggagtagggggaggtagtcgtattttaagtatttgtagaaatttagatattaaagagttatttgtgggtttgtgtgcgcgtacgtgtaagggtttgtgtatattgttacgagcggtttcggaatatttaggggaagatgggttattttaggaaagtgaaatagtttagaaattcgagaataaaatttcggtattttttgtgattaatagttggtttcgaattatattgcgttttttttgtttttttgcggcgggaagcgtagttttagagttagatttacggggggaacggtggtcgtgggcgggcggaggggtggtattttttggttggttgttcgcggggttttcgtatattttatttataggtttttgttggttttagggcgtattttacgacgcgtatattatcggtatgatcggcgttattagttattattcgtacggtagcgcggtttattcgtattagtttaacgatttcgcgtatcgtaagaacgttacgcgggacgttacggttatttttaaggtttggtttaacgagtatcgtaagaatttttattttattaagggcgagaagattatgttagttattattattaagatgatttttatttaggtttttatttggttcgttaacgcgcgtcggcgttttaagaaggagaataagatgatttgggtttcgagaaataaaagcgaagatgaggacgaggacgagggcgacgttattagaagtaaggacgagagtttcgataaggcgtaggagggtacggagatttcggtagaggacgaaggtgagcgggtagcggtcggcgtaaggtttcggggcgttttttttttaggcggggcgtagagttaaggcggggaggacgttgttcgtcggatattttaggttcgggtcggagttttagtcgtattatattgttttggggtcgtcgggatttgagcgagcgatttttcgggtttttttcggggaggttaggtttcgtttgttacgtggtcgggtgggggcgaggtgaggggtttcgtggggagggtttagtgtcgtaggatagggggcggagggggttttaggtgtttgcgttgttttttcgtgttatttatcgtgttcgcgtttttatagggattagtttgtacgtggattcgtttacggattattcgtgttcggtcgagtcggacggggagaagttttcgtgtcgcgtcggggattttttgtgcgaatcgggttcggagtgtaaggataagtatgacgatttggaggacgacgaggacgacgacgaggagggcgagcggggtttggcgtcgtttaagttcgtgatttcgtcgtcgtttatcggtttggaggcgtcgttgttgagtttttcgttcgaggtcgcgtttcgcggtggtcgtaagacgttttagggtagtcggacgttttcgggcgcgtcgtttttcgttagtaagtttaagttgtggtcgttggtcgagatcgttacgtcggattttaagtagtcgagtttgggttcgggttgcgggttatcggggttgttcgcggtcgtcgcgtcggttttaatcggggtatcgttaggaggttcgttttattttgtttcgtcgttgttgggtcgttttttttattatacgtcgtttttttacggtaattatataaattacgggaatttgaacgcggcgttgtagggttagggttttttgcggtataattttgcggtcgcggttttcggcgaggttttgtatatcgcgttaaaggcggttagcgacgcgggtaaggcgggcgcgtattcgttcgagttttattatcggttttcgggcggcggttacgagtttaagaaaggtaggcggttcgcggtcggcggcgttcgggaggggagggagagttagtttcggggaggcggagcgttcgggagattcgagggagggttcgg

SEQ ID NO: 11452 - DNA, 1059 bp, Artificial Sequence
  Description of Artificial Sequence: Synthetic polynucleotide
cggatcgtttttttttattttatttttcgggtttttattgtcgcggttttgttttattatttttagttgaggggtagttcggagttttatggttttttttttagagcggtcgttttttcgggtttttttagagttttcgaagagtcgcgtgaggaaacggggatttgttcggggtagtagatttttagcggtgaagacgtagagtatcgggttgacgttagaattgaagaaggttaaggtcgtagttttcgttcgcgtcgtttggtcggtttcgtttagtttcgttaaggtttttttcggtggagttagcgttgcgatcgtttgtagaaggttgattgcgtggtagggggtttagagtaagtcgaaggtaagtacgatggcgtttattagtcggtttattcgcgtttcgtgtcgttcggagttttagcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgtcgttagtagtaggaaggttgtgtttgtggttcgcgaagttttttagtttagtagtgtttcgttttttgggggacggtagtagatcga

SEQ ID NO: 11453 - DNA, 1663 bp, Artificial Sequence
  Description of Artificial Sequence: Synthetic polynucleotide
cgtaacggggcgggggtagacgtttttagttttagaatttcgtcgggtttatcgtttagtgtggacgatcggcgtttttacgagatttatcgagggtatatagtttttattttagttcgttttattcgatttagacgatcgttagcgcggttagcggttagcgtatagcgagttgtttgggtaattgtggtcggattttagggagtaagttggtttcgggttttatttagttttattcggtttttatcggtttttttatttaggagttggaggatggtttcggggcgttttagggggattgttggttttcggagtttttagttagacgcgttttgttgtgtgagtcgcgtgcgcgtttaatttggaggtagtcgttttcgtcgttgataggtgttgtttagagggcgtcgggtgcggtttttggcgtagttggacgcgtacgtttcggtgcgtgtagtttttcgagttcggttagagagaagagggagttagggcgcggtttgggggacgttagtggattggagtcgcggagtttcgagggaaaaattttgtaggcgtcgcggtcgggattcggttacggttttagtttattttagtaggtgcgggaggaagaggtagcgtcggagtttcgaggttagagagtttcggcggcggcggtcgtttttttttttcgagttggtttgaagtcgttgggtattttcggtttttgttgttgcgttcgtcgtcgtcgtcgtcgttatcgttagcgtcgtggggattcgggaggaggtgtagtcgaagagggaggagaagtaggaggaggaggaggaggaggaggggagaggaggagtagggggtggaggatggagtttcgggttgtcgcggcgggcgagttagagtcgtcggcggcgtttttttttttttaggttcggttttggaagaatttgtagttgggggtgggtaggagtaagggcggcgggggcgggcgcgttgggggtttagagcgtcgtattgcggatatttcgtcgtttttttcgttattttcggtgggtatagggaatgtatcggttagggggagtggtgtaggtagtaggtggagcggttttaagaagcggaagtaagtgttggatcgagttttttttttttcgtagtttaatttgtgttgttcgtcgtcggagtttttggagttcggcggcgtcggtagagtcgagtaggggtttacgttacgtcgtcggattcgcgagtatttgtttttcgtcgtaaaggggttcgcggcggtttcgggagtagcgggagggacgttttttggcggacgttttttcgatttagttttttttttttttttcgttttattttttttgttttttttgttttagtttttttcgaggggggatcgcgttcgagatgagggtgtacggcgttagggtttcggggcgtatttgtgttattagaagagtttttttttgtcgggtatcgtttgtttggagtagttgttggagtcgtcgttttttttcgtagagtcggcgcggagtttcgcggagtttcgggtttcggagacgggcgaggagtacggtagtagttaggtgagtgtcggtggcgcggtcggagataaggtgcgcgggattacgtttttttttttaggcgtttattattcggggagcggggggcgggggtcgggaggcgg

SEQ ID NO: 11454 - DNA, 2065 bp, Artificial Sequence
  Description of Artificial Sequence: Synthetic polynucleotide
cggagtaggtcgacgagagatttttgagaaggttggtagattatcgcggatttttgtttttttacgtggagttatgggcgaggcgtttaagaatttgttgaaggagttcgatttttttaagtttcgggttaggttttggagtatgaggtcgttagttaggacgtttagaaatgtattggtggtggaattgaggatggtggcggttatttgtacggggcgtttggtagtaagattgttatttttattatcggtcgtatttggtttcgtggtgtttcgtaggtttggatcgttaagaaggcggcgtagcgcgtacgaggagtcgggtcgtaggtattggtaggcgcgacgttcgttgtgattacgtacgtgtatttgggtatttagacgtattattagtagtacggtagcgttttcgtggtcgtgtagtgtagttaggtgtagcggcgtgtagtcgtcgtgggagcgtgcgtttacgtcgattggtgcgttattgcgtcgcgcgatttttattagttgtagcgttatttcgtcgtcgtcgtttttggcggtttaatgtagggtcgtgaagttagatatgaagtcgcgtttggtcgttaagtcgcggtcgcgtagtagtagttcgtgtagttggtgggtttagcggttttcggtagttcgtacgagttattcgtgttcggacggttttaggggtatcgcggacggcggcggcgcggcgggtaatttttcggcgttagggtttagtagacgcgggtcggcgcgcgataggcgttttaggtgcggggagcggttcgggtttaggtcgaggtttagatcggatttttttatcgagagtcgttttagtagtagaggggagtttcgcgggttcggttttttcgatagttgtcggcgtaggtcgggttttttcgttcggaggcggagcgtggcgggggtcgggacgtagcgtatcggtagtatatagggtttttgttgcggcggttttttcgttgtttcgggttcgggtttcgcgtttggcggattagagtagggcgatgtcgttttagaaggggttttaggcggtggggtcgcgtttgcggagggtttttcggtggtttgggttagtttaagggttggaagcggtgggtcggcggatcgtttttcgggcggttgagcgggttcggaggtcggttttttcggggtgttttgtggttttgttggtagatttaggttttttggcggttttattggtcgcggtattcggattaagggcggagttttcggggtagaggcgtttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttttgcgggcggcgcggtttcgcgggtcgtcggtatcgagtagcggtttgaagcggtttagtagttcggagttgcgtattttttcgtcgtgtttttgtaggaagtttagtatcgtcgtttggtttatttcggtagtcgtagcggcggcggcggcggttagcgttatggtggggttttgggtttttggttttcggggcgggtgggcgtcgcgtcgtcgcgggacgcgcgggagcggggtttcgggaggcgcggtcgcgtttatttggtgtttttttcgcggttagtcgggcgtgttttcgaagttggatttcggtcgcgttagtgtcgttgggtcggggcgtttcggggcgaagggcgtcgggggtcgcggggagcgtttatttttagcgtttcgtcgggtttcggttttcggggtaggtttttgtttttgtattttgtttaatgggcgtttgtttttatttttcgcgtcgcgttcgttttataggtgatagttgttttcgcgatgtagagggaatcggagtagaaattttcgtcgtttttcgttcgttttagaattaaaggcgtagcgttttagttttggtttcggttgttaggtgggtgtgttttttagggacgtcgcggttcgt

SEQ ID NO: 11455 - DNA, 3487 bp, Artificial Sequence
  Description of Artificial Sequence: Synthetic polynucleotide
cgcgcgtttttagttcgtttttggaggtagttcgcgggatcgtaggttggaggcgcgtcggcgtgatttcgatcgtcggagtcgggaggaggagtcggaggaggttgcggggggtttcggtttaggcgaaggaagggtaagaggttgttcgatcgggggcggcgtcgggaggtgggtgggtttaatatttaggtcgggggaggggtttaagagatatcgggaagggtagtcgagttttaggggcgggtggggtggtagttgtgtgtagtaggggatagggttgggtttttggaagttagagtgaagtttttttggttgtttcgtaggtaattttattttttggtagaatagttgcgaatcgttaagttgatttttttcgttttttggtcgagaggagaggatgttttaggatttagggatgggcgggaagaaattatggggagttataagtttgtatttaggcggggaggaggcgggcgggcgtcgtttcgtaggcgtaggcgagtgggtgggaagaagggagggagagggaggaaggaggtgaggtcgggaagatgttattgtcgggggcggggcggggtcggggattcggtaaagggattgtagtagcgttaggtgggggcgggggttgtaatgttatttatttgagagttaggtgtgtgcgttttaaacggggttcgttataagtcggtatttttttggtattatttatggtgtagggttttaggtagagggttggggattgcggattcgtttttgaagcgggacgcgaatcggtagagttgggagaaggtaaataagggttacgttttttgtcgtcgtttcgcgggcgcgtattcgtcgtttcggtcgtcgtcggtatatttttatttttttagcgtttttttttagttggattatcgcgcggtttcggaggtggaggttgttttcgattttagtttttatttttggcgtcgaggtttcgtattttttatatttatttggaaagggtgtttttcgtttttttaaaaaaattgtttaatttgtgtagagtttttaattttaggagtcgagtatgttgttttcgcgtgtagcgttcgcgtgtatcgggtcgggagagggggcgatagggcggaggcggtggttttcggaaggtgtttgggatcggatcggttgtacgtgagtttagcgcgaggttatgtgtatcggtttagttcggttcggcgttcggacgtgttgcgtattaataaaatgaaattcggggagataggagggtagatagttttaggttttcggagttttcgttcgggtcgttcgatttttttatcgtatttatttttcgtcgtagtttttacgttcggtcggagttcgcggggaagttgtagttttggcgcgttttcgttcgttcgcgttttttcgtcggttcgggggcgttttgtcgtagttattaataaagaaggtcgttaagtttatttttttaaaagttgttgttgtatgcgttttttttagttttttcgtattgtattttttaaaatacgattgattaatatgcgtaattttttttttttgtgttgtgtatttttttttttttcgcgttggttttttagaataggtagttagtaggagagagagggagcgagcgagtaagagagagcgagggagcgaagagcgttggtagatttgttgtaaaaacgttaaataacgtcgtggagatgcgtagggtttattcgtcgggggttggattttattttgtttcgcggtgtttttttgacgggcgttgttttcggttacgcgtcgttgtagggatcggcgcgggaaggatgttttcgaagtcgggagtttttggggtcggcgcgggagggcggggggcgcgtatttattcggggtcgcggcgagggaggcggtcgggttcgcggcgttttaggttttacgtttttcgtcggggacggtcggttcgtaggatttaagtcggtgtcgttaggagtgggcgtaaagtaattttatggacgttatttattttttttaaaaaatagtttttaattgcgatggtcgcggtcggtattatttattaattttttgtgtatgtttttgtttttttttaaattaagatttttttgtgatttttttagaaaaaaaaaatgtgttggggtgggggtggggtgggggcgggtaggaggagcgagggagggggagtagttattttttttttatttattcggattttcgttttcgatattttcgtcgtcgtttttttaatttttcgtttagttgtttggtttcggcggggagtttaggtagcgttgcgggtttcgtgggggaagggtgttttttttcgtagttttattattacgtttgttggtattttgggttcggattttttatggattttggggcgtttttagttcgttttgtttttagggtcgggttcgagcggcggttgcgttcgtgtaagttttattaggtttgtttatattttatatatttatatatatatttcgtttttttatttttttatttatattttttgtttatatttcgttttttacgcgttttagattcgggcggcgtttttcgtaattttaaaaaaaaaaaaaagcgagtttatatttaaaaaaattttttggcgttatattaatgacgtatttaaaatttgttatttttttttgcgttaaaaagacgtttttttgtaaataatagtttggaggcgatattcgcggagggaacgaggtttgtattgagtatttcgtttttcggggttttagcgttggaagattttcgttttaggttttgtttttgaatcgttggttttaaaatgcgaatcgaataaattgcgtggcgttttgtagtattagaagtgagtagaaagtgttggtaggaggggagtggaggggcgaacgcgagttttggggagggggcgcggttttttttttcgtatttattttaaatggaaaattaatatttcgggcgggggaatttgaaattgtaggcgattttaagaaaagaggggcggttcgtagagagggtttttattgggttcgtcgtttttttttttttttcgggtgttttttggcgtttagcgttgtttcgtattttcggggggtggagaaggtagtgatgagcgggtgggtgggtggttgtatattttggttttagtaggattttgtttcggggcgatttttttttttttgttttttttttttattatttcgaaaggttaaaaatcgaggggtaatttttaaaggttggtatatggcgaggaagcggggcgtttttttttttatttttcgttttttcgttttttttttttcggttttatttttcgatttgattttgtggtgtataaatagtacgttcggattttcgtagtttttggaagaagagtttgcgttcgttaggcgggcgggttgtcgggttgttagtcggcggtggcggggttttgggtttgttttcggagtcgcgggttatatttatttaattcgttgcgttcgtcgagtttattttttttcga

SEQ ID NO: 11456 - DNA, 847 bp, Artificial Sequence
  Description of Artificial Sequence: Synthetic polynucleotide
cggtcgttttagtaaagtttttaatttagtcgatatgacgcgcggcgtagttaatgggaggcggagttggcgttttttggtcgggggggggtcggaggggtgggtttcgcgttttcggtgtttgtcgtgtttattgaatggagagagcgagcgtcggttagtttattcggtcgtttcgtgttttagtcgtagtcgtcgcgttttttagtttagttttaagtcggattttttcgggcgttacgttttattgcgttcgttttaggtttttaattcggttcgcgggttagcggggttagggggcgtttcgtatttgggtatttttagcgatgcgtagcggggtagcgtcggtttcgtcgatggagttgttgttgttgtcgtcgtcgtcgttcggagcgtttcgtttcgttcgcgtttcgtgcgtttgagtatcgagttcgtttttttttcgcgttaatttcgtcgttcgttttttaggtcgttcgcgtttttcgcgcgttttttcgggttttacgcgttttgtttcgtagaggtagttttttttaggagcggggttttgtatattatggttttcgggtgggtaggggtcggcgtcgtcgtgcgcgttcgtttggcgttggttttggcgttggcgagcgttttgagtgggtttttagtcgtcgtttgttttattaagtgtatttgtttcgttgttagcgtggattgttacgggttgggttttcgcgcggtttttcggggtatttttcgtaacgttgagcgtttgtgagtatttttgttttattttacgcgggttatttatttgggttttatcgagggggttttaggcgttagattcgtttttttttttcgg

SEQ ID NO: 11457 - DNA, 909 bp, Artificial Sequence
  Description of Artificial Sequence: Synthetic polynucleotide
cgggacgggggcgagattttgggtttttaggggtattgaggggtcgtttatgtcgggggatatggttatttgggggcggttttcgttaatcgcggagtggggaaaaggggggagggatggaggacgaacgttcggcggtgtttaaaggtacgacgcggagtaggaattatagttttggtttttagaaagcgcgcgcggttcggggtagaatttgtcgaagttttagttcggggcgtaagggatgtgggggttattggaagacggggcgcgggtcgttcgtggggaggagattggattcgaattcggtttattttattcgagcggcgacgttagcgttgattttaggcgtgtttcggttttcggcgcggtttcggtttaatcgtgtacgttcgcggaaggtttcgtattcgcgttagaagtggtttgttcggggttatcggttcgtaagttttcggtgttttcgaggtttttgtttcgtttcgcgcggttgtagtcggcgggaggggttgagaggcgggtcgcgttgggatttaaggcgtcgttttttcgttagttttttttttttttcgttatcgggtggtcggagattcgggggtattgttggggtattttaaagtatagggttagtttgagtgcgtaaggttttgaaaagacgggggggcggcgataaggagtagggaggggggttggaggaagacggtaaagtgatttcggaagggtttaggcgttttaagtttatcgaagacgggaggtttttagtggcgtttggggggattgtgggaaaagtagtttaagaaggggaatttggagcgaggtgggggagaggtcggtatggttttttttaggagcgttagcgttagatagagcggtgataggtcgtatcgggagtatttcgtttatattgaacgg

SEQ ID NO: 11458 - DNA, 2150 bp, Artificial Sequence
  Description of Artificial Sequence: Synthetic polynucleotide
cgtttttcgtggtcgggaaggttaggtcgagcggggcggttagtcgggtcgggaggagggggtttttcgggtcgcgcggtcgtataaagcggggagatttgttgttgcggcggtatgaggcgcgttttttttcgcgagttagcggagcgcgcgcgttcgttttcgtttttcgtttttcgttttagttttcggagcgttattcgcggagcggtttacgttagtcgtcgggcgtatcgcgttttagcggtcggggaggtgcgttgttcggttttcgtaaagttattgtgaatggggagcgggtgacgttagcgtcgaatgttaataatgtagcgattgagagtgtgggcgtttcggggagagcgtaagtcgcgcggcgcggagtaaatagcgtcgagtcgtcgtcgttttagtagtagtagtagtagtagtagcggtagtagcggtcgtgtacgttcgggttgcggtcgtatagcgttaacgtgagcggtcgtcgttttcgttatttcgtttgtttattttcgtcgtcgtttcgttttcgtttttttttcggttttttttcgtttttttttttttttttttttggcgtattcggggggttgggaacgagttgttatgtgatgcgcgtttttttcgcgagttttcggtgatttacgaattgtttatttcgtcggttgtcgggagggggttgcgagtcgggaagacgcggggaagaggaggcggaaaaggacgtaaagtttttcggcgaggtgagtttcgggtttcgggtttcgggtttcgtcgttgggcggggtggcggggtaagtttgcggggggagcgggcgcgcggggcgggcggggaggcgtggggaaacggcgcgggaagggagtttcggtcgtcgggcgcgtagtcgtttttttcgcgttttgttcgtttttatggtattttttaggaacgggaagggggtgggagtcgagtcggcggtcgcgtcgcgtcgaatgtgtgttttttttttcggttgtttacggcggtcgaggcgtattgtattttgttggcgtcgaagggtgttttggaatagtagagggaggaggagtagagagtaataagttaggtatggggagggcgggttgtaggaggcgcgcgttcgcgcgagtcgtagtagttgttagattcgcggttttgttttcggttcggcgaggttcgggtgtttcggtttttagtttgcgattttagttttaggtcgggcggttttttttttaattttcggcgtgcgtatttcgggttgtttcgcgaggattttggtcgcggcgtttttgcgtttagttgttagtcgtcgtcgggtggttcggattatcgcgatcggcggggaattaaagtttaagtttagggtcgtaggaagaggcgagttgggggtttcgcggcgtagatttggatcgaattttttttagcgaaagatcgggttgtcggaaagcgtttcgcgtagttaagatttaagggcgttaggtttttgagagggaaattttgtatttttttttttatagattttttatgaagttaaggtgtaatatatatatatatatatatatatatatattttatattttagtttttaagttttagaagttttatttaggagattggtttatgaaggggatattgtttttttcgttttcgcgtcgaggcgtttcgtggtttcgttgtgtttcgtttattcggcgggtgttcgggagttcggcgtcgttggagacggcggcgggcggcgtttacgggttattttaggtgtttacgaggggagagattggagcgagtatttcggcgatttcggtttggttaagtatttgtaggaattcggatcgtgaggggaagcgtgtagggtcgggagtgagtgtgtgaaggggtggtatatttttggtttttggggtcgcgggcgtatggggtatttttagtattttttcgcgcgtaggcgagtttggtaatttgagggaagtttcggcgcggtcgttgtcggggtggtttgtttgtggttcgatgaggcgcgtttcgtagtttgttttttcggttatcgtcgtcgtcgtgatttgtggtttttaggaaacgagagggatcggggcgttttattcgcgagacggattcgtagtttttcggcgggttcgcgggcggcgagacgcggcgt

SEQ ID NO: 11459 - DNA, 506 bp, Artificial Sequence
  Description of Artificial Sequence: Synthetic polynucleotide
cgttttacgacgtttatgttagggttttttagattagcggagaaattagtagttttggatcgtaagcggcggggttagggaggcgataacgggaagtttttgtcggattttggatatttaggatttagtgttgttcgggcgttttttcgtagtagttttagggcgaggaggatggggggggttttcgtaggggttatattgtcggagttttacggattcgggcgggacggtgaggtttttatattgagtcggtggtaaagttttcgcgaggatgaaggaggaatttcgtgttttttattttattaggtttcgtattttttggttttttttgttttaggaatcgtttgttttttgtcgcgatcggcgagttttttcgggtttttttgaaatagtttcgtttcgaggttttggatttggaagtttaggggtatcgttcgggagcggggtatttattgtgggttttcgttagttagtatttaggttcggagttcggggatagcgggcgt

SEQ ID NO: 11460 - DNA, 1503 bp, Artificial Sequence
  Description of Artificial Sequence: Synthetic polynucleotide
cgcgtttttgggtatttagaaataggtttttttcgggaattcgttttcgatcgggcgtttttataatatttgaagttttttaggacgttttttgagttgggtaaggcgagaggatttttttttagagtttagtttcgagtaatgttcgagttcgcgaggtggggttgggggcgataaggaggcggagcggggatttagttatcggggatttttttttaagttagtttttaaattattcggcgttatgtatttatagttcgcgcgtagttcgtgcgttttggattttatttaagtattaggttcgattagggtcggttcgaaggttatcgtttacggttagggtagaggggcggcgggaaaagggtttagtggattttcggtttaggagggtcggttagttgttgggtcgcgggtatttaaagttgcgggggttcgggttttcgattttacgtttagcggggttttagtattcgagggcgcgcgttgcgattcgtagagtagcgggtgtagtaggttggcggggttgggatcgcgagttttgtttgtaaagtttaggcggggtagacgttagggagggggtcgcgtttacgcgggtagtttcggcgttgataggtagcgacgtattttttcgtaattcgtttattagtagtttaaagtgtgtattgggtttttagtgaaatgtttggttttgaaagtttagttaatatcgggtttagcggagttattagggtcgttttttgtttcgtagaattaggttttggtttcggttacggtgggggtttcgtattagttcgataatttcgaggttacgcgttcgaaggattttttgggataagaagtggagtggggcggttaggacgcgggtcgtggggatcgcgagggaggagggggcggtcgttcggatttatttcgtggggttttcgcgcgcgggcgtttcggcgtgtcggattatgtcgtcggtagtttcgggacggggaacggaggcgtttaggcgtcgggtcgcgcggaacgcggagtttcgggcgttcgtatgtttttggttttggttttttggaagggttaggtcgtcgttgtcgtcgcgttttggggttttcgtttttttttattttttgtatcggagcgagcggggtttttaggaagaggttggttttggtggttaagggtttttttgttaaaagttattcggtagcggttcgcggttcggagttttttggggtatacggaggttcgggcggtcgcgttttcggggtcgggtttcggggcggggggtgttggggttaaggcgtcgtacgggcgtttaatttcggggtgtcgtttttataggttgtggttggggttggggcgcgggaggttcgcggggtttcggagagggaaatttagagaaaagttttttatttggtttggggtcgtaggggaaggaagacgtttttcgtttgtgtcggcgtcgatcgcgggtcggtaggtggggaggtttagagttggcggggagttcgttttattcgg

SEQ ID NO: 11461 - DNA, 907 bp, Artificial Sequence
  Description of Artificial Sequence: Synthetic polynucleotide
cggtttacgtgttttttattttggttcgtagaggtttgagtgttgtttcgggtagtttcgggtagggttgggtagggtttagcggattttacgggtcgttttttttcgtttttttttagttatttgtttgtcgttttttttcgtttttttttttttgaggtgttgtttcggttttcggggcgggggtagtcgcgggtagtttagttcgtagcgtttttagaggtgttcgagttttttgaacgtttcgtaggaaagtagttgtgttgcgtggagtttttttttcgtttcggttttttcgttcgtgtttttgtttttttcgttttgcggcgggaggtggcggtgtgggttttcggggaggcgcggcgggttggggaggtggggaagggtgtgcgcgtgttgggggtgggggggaaagatttgtcgtttttttttttcgtttttttagtttttggttgttatgtagtttttatggtagcggtatttttagatttaatttttattttcgtttagagttaattaaggtaaaatagtgaggggaggagggaagagcgtggttagggaagggaggggggagaggtaggaaatttaattcgaagttgtaagtgtagcgtttattttgttaaagtcgtagtatagatttcgaagtcgtagcgtcgttttttttttttttcgttttagttcgagcgggaagcggtagtagttttttagagttttggtttggtagggaggggacggcgttcgagtagttatattgtagtttttcgggtttttttttcggtcggcgtaggtttcgcgtttacgattttttttgggagtcggatttgttttttttatcgtcgttattcgtcggtttttgcgttttttggttttcgatatttcgtttggtcgtttttttgtgtcggttcga

SEQ ID NO: 11462 - DNA, 1925 bp, Artificial Sequence
  Description of Artificial Sequence: Synthetic polynucleotide
cgggtttttcgtcgttttggggttgagtttggtgtcgttgtttatattgaataggacgttttttttcgtgagcggcggaatcgttattcggtaaagcgggtgttcgaatagtttggttaggagggaggcgttttcgtcggggtcggggggcgattcggatcgacgcgggtcggggtttcgtagtagcggtcggtgcgcggggtcgtggggttttagggcgtcgggatttcgttttcgtaaggcgcgttcggtcggttcggtcgcgggcggtagtttttttagcgagtgggacgagaggttggaggaggggtcggagttgaagttttgtaggatgcggagcgtgtgtttgttgggttagttcgcgtcgtcggcggcggaggaggcggtcgggggtttttcggggcggtttcgaatttgggtttagtcgggcgcggttatttcggcggcgggttgcgcgtacgaatagtcgggttttttcgagggtcgcgcgtcgcgtcgttttagtttgggtagtaggtttagggcgatgtgtagcgcgtaggttattaggaatattattaggatgagtacgcggaatcggcgtattagtattatttttatggtcgcgcgggtcggttcgggtttggagcgcgttttgttcgcgcgtttttttagttgtagttgggtacgagcgcggcgtcgtttcgcgggttaaggtttatcggtgtcgggcggttattagtttcggggttgttttcgggttcgggtcgcgtgtagggcgttcgtcgtcggagcgttgggttttcgcgttatttcgggttcgttttcgttcggttttttcggagcggtcgcgtttttagtcggggagtttaggggttttggttcgcggagtcgggcgcgcggggggcggttggggtcgtagtagggggaggttcggcgttcgtagtcgtcggcgcggggtttatcgggcgtgtgggtttatttcggtcggggcgcgacgggtttgggcggtggcggcggtcgtaggcgtttcgatttttagcgcgtttttttttaggcgtcgggcgggcgggcggggaaggggcggttttttcgggtcgggttttgtttttacgtcgcgttcgggagatcggggttggggggaaggggggggcgaagggcggaaggggtgggcgcggggagcggtcggcggggtttcgggtaggtgtagcggtcgtttcgagcgtagttttcgtttggtcgagtttttcggcgtttcgcgtttcgggcgggtagatatcgagcgtcgcggagtcgtttttcgcgttagcgtttatagattggcggagtcgtcgttttacgagttacggttgggttcgggtcggttgcgttttcgtttttttttttttttttttcggtcgcgtttcgcgacgtttttgagtttcgggttcgttaaggagagggttttttttgttcgcggtttgtagagggaagcggcggagatcgggagggcgcgttcggttttggttaggttagtagttgcggtcgagtggggggtttcggtttggtcgttttttgggattttttttcgttcggggtcgtcgtcgttagttgtagtttttcggtttttttttagaggagcgcggggtcggggtttaggttaagttttttttcggagtcgcggggcgtttgcgtcgtcggatgagtttttcgtcgggcggcgatttcgtgttttacgttcgtttcggtaaggaggaggcggaggcggtttcgcgagagaggtttaaggagcgattgggtttggatttaggggacgttagggtagcggagttttcggtatcggtttcgttttttttttttcgtttattcgcgggacgcgttcgttttaattttttaggcgtcgggttcgttgggggcgttgagaggggttggtgtgtcgggggcgtttttttgtttggggtcgacgg

SEQ ID NO: 11463 - DNA, 1287 bp, Artificial Sequence
  Description of Artificial Sequence: Synthetic polynucleotide
cgcgtggttcgggaggttttcggaggagggaagggtttattttagcgaggggtataggcggagaaggtgcggggcgaggcggtcgcgggtttttggtatttttttttttacgtttaggttaagttggcggtgttgttggtgacgttggtggtggtcgcggttttttatttgcggatggagtagaagttgcggcggggcgtggtttcgcgttagtttcgtatttcgcggttttagtataaggtgcgcggtgacggttatttggaggaggataattcggacgagagcgacgcggagggcgagtatggggacggcgcggaggaggaggcgtcgttttcggggtttaggtttggtttcgagttcgttggattcggtcgtcggttttgttcgtacgaataggcgtaggggggcgacgggtcggaggagtagtgaggggtcgtttggttttcggatttagtttcgtttttcgtcggttttagtttattacgttttaggtcggggggatttttttcgagtttcgcgttgttttcgaaggtttttgtttttttttttttacgttggggacgttttttttagagttcgggttattttcgggttttcgtagttttttttaaggcggagtggagttttgggaatttttcggttaagtataggggttcgaaaatatagttgatatttcgcgggtttttagtacgcgttttagcgtcggagtagggttagggtttttttgcgattcggtttcgttttagatttttttagttttcggtcgcggattcgggtcgcgtgtgagcgttttttgtattttttatttttagggttcgtcgagagttacgattttttatagaaaatgagcgataaagagattttgtattgttttgattggagagttttaggtcgcgggggacggagcgtttttgggatgtacgttcggttggttcggtttttgggcgcggtggtgagaggttttgatttagggggatcgcggggtgtggggagtgcggagttttattgggggcggggcgaggtgttcgtaggtttcgtttattagtttttttttttttttgaggtttcgtttttttatgtttgtttgtttttgttagttttagttaggagaagggagcgggggagcggttggtagagatagaggagggtgtgacggcgttgttggttttttatgggtttagagggcgagatagatttcgaaggtatattttttaggggtttgtgtaggtattttcggttttttagcgattattttcgcgtcggatagggtttattttcgagttacgg

SEQ ID NO: 11464 - DNA, 2906 bp, Artificial Sequence; identical to SEQ ID NO: 7254
  Description of Artificial Sequence: Synthetic polynucleotide

SEQ ID NO: 11465 - DNA, 2146 bp, Artificial Sequence
  Description of Artificial Sequence: Synthetic polynucleotide
cgaaagcggttttgagagcgttttcggggttttttcgaagtgtttaaattattagcgtggttagcggtttcgattttttattacgttttttttcgcgggtttaaagggatttgggtttcgtaaatttttgtcgagggagacgttcgtcgatttcgtcggtttacggggcgttttgtttttttcggggcggttttttaggtaggttgagagcgaacgggatgagtatatttcggacgtttaagggggcgtttagcgtttcgaagtcgtcgttttggtttgcgtcgtcgtcggtttcgttttttcgggtaggttggaagcgttaggtgttcgcgcggtttacgtagtagatggcgtcgtttagggcggcgtagcggaagggttgtaggttcgtggggtcgtcggggaggcgtaggggcgcgacgtacgggttttattgtttggttaggtagtggtatcgggatacgttgatttcgttcggtttcgtcgtttgcgtttcgtcgcggttgtcgtttagatcgaagcggtagatgaagtcgtcgagagttattatgtcggtcgagcgttcgcggttgttgttgtacgggtatttttgttattcgtcgcgtcgcgggttatatttgagtaggcgatagaagagggagttttcggatacgtagatttcgtcgtggtaggtggtggttttatgcgttacggcgaaggcgtttcggggtagcggcgttacgggggtttagcggtcggcgcgcgggtcgtagcgttttacgttgagtaggtattcgtcgtttacggcgtagaggtgatcgtttagggttagtagtcgtagttgcgagcgcgtttggcgtaggggttttacggcgttttagttgttcgtggtcgggttgtagtagaagatttggtcggacgggcgcgcgcggtcgtcggggttcgcgggcgttacgtcgttcgttacgaagaggtagttgtagaggacgtataggtcgtagtttcgcgtcggcgcgttttcgggtagtcgcgttagttcgcgttatttttcggtcgtcgcgtggaagtagtagacggtcgcgttttcgcgcgcgttcgcgtttttcgaggggttttgaggtcggttgttcgcgcgttttttcgtcggttcgagcgtcgcggttaagaggtgggcgcggtcggcgcgtaggcggcggcgtagtagtaggtttcgttttgcgttcgataggcggtcgaatacggcgggttcgcgtagtatttttagatagtggtcgtttatgaagtagtaggcggcgtcgcgtagttcgtttagtcgttgtcgtttggtcgcgtttaggatttcgtagtagttggttaggtttagttgcggttttacggcgtcggtggcgcgttgcgcggcgtcgggtagttgtaggcggcgcgcgtcggttattatttcggttacgttgtcgggtcgtacgttcgttatgcgttcgttgtaggcgtcggcgaggagtagtcgtagcgtcgttaggtttattttttgtattcgtagtacgtttcgcgacgcgcgcgcgcggaagtagtcgttgcgcgtcgttagtatcgttttgtgcgcgcgtagtcggcgtttcgatatttttagtattaggttcggtttttcgtatatcgtttcgaatttcgggggtacgggcgcgggtttttcgggtttttcgggggacgcggggtttttaagttaaacgcgcggttcgggggacggcgtcgcgggttttttcgggtacgcgcgttttttaggggacgcgagttttttcggggacgcggcgttcgcgttgtcggttttttattgtcgttttattattcgcgggttatcgttggagggcggggaggtggtcgcgtttttcgtcgttgaggcgagggattgcggcggggattttttttcggagttgaagtatagggacgcgtcgagattgtagggtgtttgcgtcggggacgcggcgttttcgttttcgtttttttcggtagtttcgggtttagtttttgggtagaggacgtagggggttatcgcgtgttttatggtcgggttgtgttgcgttgcgttcgcgcgttttcggtttcgtagtttgtaggtttggttaaggtcgagttttatttcggggtttttagttttatagttttttttggtacgcga

SEQ ID NO: 11466 - DNA, 865 bp, Artificial Sequence
  Description of Artificial Sequence: Synthetic polynucleotide
cgggagtttttttttttcgtgcgtcgttgttcgggacgagaaattcgtggggtatttaggattaggatacgaggttttagtttgggtaggtggataagttgtggggttttatttttcgtaggcgatggttttttaaagtttgtataaatcggtttcgtcgggtcggttatgttcgttttttttttcggcgtgggaagtttttttaaaagtggaggggagcgagtgtcgcgttttgttaatttcgattgcgtttgggtttttttcgcgtcgggtttcggagtcgttttttttgattttgcgattacggtcggggattttgcgcgcgttcgggaatgtagagtttttagcgtcgcgtagggttcgtttcgatttcggtcggttttgggtaattcgtttcgcggttagtttttattttaagatgtggttcggtttttattttcgcgggggggaaatgtcgggcgatttttatattgatttttttgcgtatttagcgtaaattacgaatttagagttggagttgttcgtagatttcgcgtagttagatttcgcgtttttatttcgtttcgtttcgtttcgtttggcgtattaattttcggtcgaggaggggtcgcgtggcgtcgcggggggcgggtcgcgtacgtttttcgtagggaggatttagggatagttagggtttcgggagagttcgcgcgtatcgttcggtttcgcggcgttagttatggcgttcgtgcgtggtttcgttagggatggggcgacgcggttagagtcgtacgcgatcgaaattcgtattttggagtcgtagagcgcgcggttttgttgtttagcggttttttggtaagtgacgtggggaagaaacgtagggcgt

SEQ ID NO: 11467 - DNA, 865 bp, Artificial Sequence; identical to SEQ ID NO: 11466
  Description of Artificial Sequence: Synthetic polynucleotide

SEQ ID NO: 11468 - DNA, 1463 bp, Artificial Sequence
  Description of Artificial Sequence: Synthetic polynucleotide
cgtaatttggggttcgtagacgcgcgtggatataaaaatatacgttttcgagatttatttttttcgggttatattgtggggttgcgttcggggtacgggttatgtttgaatttttttttatcgtcgcgtttcgggttcgcgtttcgtcggtcgttcgtattgggtttcgcgtcgttttcgttattatatcgagtcgtttagtattttttttttttgaaggttggtttcgttcggggtgttttttttttcggttttgtcgtcgttgtttattttttcggttttttttcgtcgggtcgggtagggttggggcgcggggttgggcgagggcgcgttagtttattggagtttttttcgggcgtcggggttttttcgggcgggcgtcgcgggttgtggggttggagttggagtcggggtagtggttgtcgggttcgggttgggttggggttttcgcggcgagtttgcgacggcggcggcgggcgatttaggaagtgtaagggagagacggggtagggcgcgggtcgggagcggggtatcgagataatcgggtttcgggagggcgatttggagagggagggcgggagttaggggaggaaggaagaaggaaggaaggaaggaagtaaaggatggggcgaggacgcgcgttttaggagtaagcgcggagagttggggttgggggttgtagtcgttggaaggaggggacgggggtgtttagagaggaggaggaggaggaagaggaggaggaggagcggggcggaggagcgcgggtcgcggttgggacgttgggattcgagagtcgttgagtacgcgttttaggtaggttttgggaagttcgggatggaagtagttttttttttttcgtttttttttttttttttttttttttttttttttcgcgtttttttttttttttttgttttttttggacgtgggttgtcggttgtagttcggagggacggggcgcgggacggagtttttcgcgggaggaggggtcggcggtcggatggcgcgcgtcggggaggggtagcgggtcgcgggcggaagcggcgattttagttttcgatttagcggttggtcggagggcgagggttcgggaggtcgagggtagggaggtcgggtttcgtcgtttttttggttttcgggggtttcggcgtttgcgcgtttcgggatttcggggattttgtttcgtcggggtttggatcgggatttgggatgtgtgcgatttttagtttgtcggtttttatcgagggatttgtatttttggttttaagtttatttttttcgagttagattcggttttttttttgttgtttgaatgatagtatgagaattcgagggatatcggggatagtttatttcgggtcggtttttttaggatagggttttaaatttatttttagcgcgggttttgcgacgcgttcggagtttttttcgtttcgttttttgagcgtttcgcggtttttcga

SEQ ID NO: 11469 - DNA, 1437 bp, Artificial Sequence
  Description of Artificial Sequence: Synthetic polynucleotide
cggtttttcggagttgaggtttgcgcgattggatttaggggtagaatgagtgcgtcgggaattttaaaattttagattaagatataaggggagtcgacggttcggaaatttcgttgcgggtgttttaagcgcgaggtcgttcgggtagggtcgtttagggatcggggcgttgggtgcggggtacggggttttatttttcgcgggttggggcgcgtagcgcgcggtttttttaagaaagttcgtcgggcgagtttattaaagtttaaaaattcgtcgtggagaagggcgcgggggaagaggagagagggagagcgttgatttaggcgagagagaggggaaaggttcggtcggaggtcggcgtttcgcggtcggggtcggggcgagtttacggtgggcggtggggattggttgcgcgttttttcggagatcgcgcggcgggcgggggagggggttggtcgggttttagttgaggtcggtttcggtttcgtttttcgtcgtcggcgttcgttttttttttcggcgttcgtttttcgtcgtcgttgtcgtcgtcgtcgtcgtcgtggcgtattcgtcggtcgtagtgaaaaggcggaggcggcggttttttcggtttttattgtttttttcgtcgtattttttttttatttttcgtattcgttaaatttgatgtgattttggttcgacgcggaggttgttttttttattgtttcgtgggtttttcgttattcgtttcgtattcgcgagcgtatcgtttttcgcgtttttttttatttttcgcggggtcggcgtcgcgttcgttttcgcgttttttttcgtcgttttttttttcgtattatgagtaatttgaagtcggacggcgagtacggcggtagtatcggtatcggtttcggcgcgggtttcggcggcgttttggaggaggaggtgggtttgtggtttcgggatttgtcgggtgaagcgtacgttaggcgggcgcgggagagggcgagcggggtttgtcgcgtttcgcggggtcggggtggttatcgttttcggcgttttttcgtcgttgttttttcgttcgggtaggagcggttcgtgttcgcgggcgggagcgtgcggtttggattgtttcgtcggataggtattgttttttcgttttttcgggttcgaggcgggtcgcgcgcgtcggtcgtcgttcgggcgtttcgcggtgggcgagatgcgtcgcgttcgttttatgtttgtcgttcgcgcgttttttgttttttatttcgtagtcgttcgtcgttttttttcgaggcgtattttttgcgtggttaggatttcgtttcggcggtacggagcggagcgggattagtacggttcgagggcggtatttttattttattgtttttttcgttttgatttttttttcgtgattttggaggtttgggtcggtcggtttttcggtttttgcga

SEQ ID NO: 11470 - DNA, 717 bp, Artificial Sequence
  Description of Artificial Sequence: Synthetic polynucleotide
cgaggagaaaggtcgttaaacggagcgagagtttttatttttatttattttagtgttatggtggtatatgtcgattattatttgcgaggttttttcgtagatttgttttttcggtttcgtagcgcggacgattcgtagcgttttacggttatggttttttttataggggtgagtttgtttttcggatgggtggtgaagggtgattttggatttgatttttgaatcgtagcggtttgtacggggatcgcgggcgtgttgattttatgtgtttcgtttagttgttgtagagtcggtttatcgtacggtttttgcgggaggaggttattttggagcgattttttatttggtagggagatttcgaatttattgtgcgttggttgggtttgttgggtttgggttatttcgcgttgaatcgtaggaaggtgtgagagaaggggaggggtggagaggggtttggttcggtcgcggcgaggtttgtaagaggttgatttcgagttttagtaggtgcggtacgtgagtacgttgttgtcggcgtttttgggcgtattgggcgaaggcgacgcgcggttcgtgggtgtagcgttgggcgttttgaggaggtttttgttgcggtttcgggcgtttgtgcggtttttgagcgcggagttgggatcgcgttttttttcgttattggacgacgtgagtaaacgtttcgttttcgggtttcgtttttgtcgt

SEQ ID NO: 11471 - DNA, 1713 bp, Artificial Sequence
  Description of Artificial Sequence: Synthetic polynucleotide
cggtagcgaattaagttgcgtaggcgttttgtttttttttttattaatatgttcgattggtttacgattgattatattattggttcgcgtaattttagtaggtttttgggtttgtagttgagtcgaagtttttttttttgcgtagcggggcggggtacgatggtggcggggggggaggggggaattgttttattacgtatgcgtatcggggatggcgatagggtttttttttttgtttttttttatagttttttttagtcggggggttgagtgtttttttttttttttttttgttttttttttttttttttttttatcgtttagcggggtttttaattgatagttgtcgtcgggtttcgttcgtgtatcgtttttttttgttcgtgtttttcgtaggtagaggggggcgggagggggtgtgagggagaggaggagtcggagtcgtcgttgcggtttttttcggggaggggagaggagaatttttttttttttcgtttttttttagtttttcgttggttcgggagggggtggggcgtcgaggtcgcggcgattcggtagggtttggtcggtgaagagtaggcgggcggggtgcggaggggtgaggtcggcgagggtcgtgcgcgcgtcgtcgtcgggggggaggggagaggagggtatttaggttttttttttttttttttttttttcgcgcgttatgtaatttcgtttcgtcggcggtgagtttaagattttcgcgcgtatcgagtcgagtcggcggttgaggagagttaggttcgatgtggcgggggttacgcgtcgcggtcgagtcgtgaggaagcggttcgcgtttacgcgttttttagtatttcgagcggttgttttatatcgtttagtttaggtttgtcggggtatgagtgtgttcgggacgtcgggagcgatggagtcggttggggaggaagagcggtcgttatcggcggtcgaaggagaggacgacgaggaggaggtggtagcggcggtttagattttagggtcggtttacggaaggagtgttttttcgttggaggacgcggacgattaggaggaagagatggaggcgatggtgatcggaggcggttgttgtaaggagtaggagttgatttacgagttatagtagggttatcgtattttgggcgagtttttgtaggagaagtatcggggttttatcgttttttttttgtagtttttggggggcgttgttatcgcggaggaggaggtggcggaagggtcgcgtagcgggggtcggggcggtcgcgttttttcgtagtagttcggatagggtatgtgtttgttgtagatggaagagaagttcgttagcggttagtacgggggtattatcgagttcgtggcggattttaggttgatgttggagacgtgttatcgtttgtacggagtggattattggatttttaaatagggttagaagttggagatgatgttggagtagaagttagcgtttttttttcggtaagcgagttcggttttcggtgggattgatagattgatataaatatatatttatacgtgttcgaggatgggttgggttaggggtttgggggcggcgttgataggtgttgagtcggtgttggagaagttcgggaggaggagcggcgttgggcggggatcggaggggtgtggtgggtgtgggtcgaattcggtttgcgcgtagattgagaaggaaattcgagtttgtagcgt

SEQ ID NO: 11472 - DNA, 699 bp, Artificial Sequence
  Description of Artificial Sequence: Synthetic polynucleotide
cgcgcgaatcgttttattttggatttttggaatcgtgtttaggtattcgggcggcggggttcgtttaggtcgcgttaggtagttttgggtcggtgggtgtcgggtttttttttttttcgttttatttggcgcgttcgtagcgtcgtcgtcgtcgtcgtttttttttttagcgggcgttcggagtatttcgcgtcgcgtttttttcgtttcggttttcgttcgtcggagcggggtttacgtcgttggtagttattaagtggttcgttaaggaaatgtaggtgagtgcgtgaggtcgagcggtagttgttggagacgtggggtgtgtgtttgtgagtgcgagcgagacgaggagggagcgttagcgagcgagcgagcgagtgcgggagcggtcgtttcggtttttcgtttagtcgcgttcgtagtcggcggtcggagcgcgtgggggtagcgtttcgtttcgatagagtttcgttttttttttgtcgtttcggttgttttttcgaggagtcgggagtcgtttatcggtttttttaattttgcgttttttttttagttcgagttttttcgttgtttttttttttttttttttcgagtttttttttttttggcgcggcgtcgttagttagtttcggcggggagagtgtaggtattttgtttttagaataattagtaggatttaagtcggtttttcgagcgcgt

SEQ ID NO: 11473 - DNA, 1191 bp, Artificial Sequence
  Description of Artificial Sequence: Synthetic polynucleotide
cggagcgggcgaggacggttagtttttgtagtgtttaggtttgtacggaagcgttttggtataatttagttgaggatatacgttttttttcgcgtagtcggagggttgaatagtaaagtatttttcgggggaattgtgtgttagcgtagtttggagagagtaggtttagggggtagttttattataggagataggatacgttttagtttgggtaaattttcggttttttttggttttaagttagtagtcgtcgttcgcgatttttttttttttttcgtcgttatttcggtcgttttgttagtttcgaatttgttcgcgtttggtcgcgcggttttttagtttacggggttggcggcgcggttgggatgggatcgatgtggcgtatgcgtggtggcgttattaggcgcgggagttgttgcggcggggacggtgttgcggacggtcgagggttaggtcgtttcggtcgggtttgtggtgggggtagttttagcggcggcggcggcggcgtgggttggcgaggtcgcgcggacggcgttcgatagtagttggaggagcggtttgtcgatttggcggcgagttatttggaggttattcgtgcgcgggacgagtgggatcggtagaacgcgcggttgcgttaggagaacgttcggttgcggttcgagaatcggcggttgaagcgcgagaatcgtagtttttttcgttaggttttgcggtttttcggcgaaggcggtaacgggacgttcgcggaggtacgtcgggtttttgaagaggttagtacgaatcggagggttagagatagcggtcgagaggacgagtcgggtagttttagggttttgagggttcgatttgagaagttggaagttatgtatcgtcgggttttgttgtagttgtatttcgagtagcggggattacgttcgagcggggataaggaggagtagtttttataggaattcgatttcggttttcgttttcgggattcggagttttttgggttttggttgtagtcgaggtcgtagtcggtgagaggcggagtttcgagcgggttttttttttttcgtttttagttattttcgatttcgcgtacgttttggttcgttttttgttcgcggatattttggattacggtgttttttcgtttttattagtggatattttcgggtggcgtttggttattcgtttggtggaggtcga

SEQ ID NO: 11474 - DNA, 536 bp, Artificial Sequence
  Description of Artificial Sequence: Synthetic polynucleotide
cggacgggatgtaaagtttgggtgagacggttatcggacgtttattggaagggtgcggggatttttacgtcgatatttcgttttttcgttttagttcgcgtatttatcgcgtacgtagagtagtgatatggtcgaggatcgggtaagtttttgtcgcgttttagtcgcgtcggatcgttttttttttttttttagtaggtgtcgcgattgttttcgttatcggttttacgggtttggtagttttttatggtttcggtcgtaggtagcgtttcgtcgttgtttcggattcgttttaaattttatcgtttgagcgaatttcgggtagcggtgagtatcggtcggtaggttggggattgggcgcggtatagcgacgttatcgttgggaggtaggagttgtcgggattttttttcgttattttattcgggattcgcgcgagcgtttgggcggagttaattcgtggtgtttcgttttttagttaattaatttacgtttagtttatcgatttcgttttttttcgcgagtacgtaggaggcgg

SEQ ID NO: 11475 - DNA, 728 bp, Artificial Sequence
  Description of Artificial Sequence: Synthetic polynucleotide
cggttaatacggttaggtttttcgggcgttttaaggtttcgttaattttggtaaaggcggtgttgaggtgaattacgtggatttgaaaaggatacgagggtaggagagggttacgtttttggtttcgtttcgtttcgtttttttgttttttttcggttagtttcgcgtttatttcggtagggaaacggtggttttttatagtgtgtttcgagttcggacgatttgtagttttttagtgtagatgtagttgtagagttcggtattttcgttcgggatttagagttatttttagtttaggaggtagggttagttgtattgcgtagggagaggtaagtgagtcggtttcgttcggtagggttagtttaattttcgggtaggtattgtcgcgacggtttttttttttgcgtttcgttttatttttaagtttcggcggggagatttttttattattgtggttattgttgcgtaggcgtagttttgggagcggcgggagttggaagtttaggagttttagggggcgtagggtcgggtagaaggcggcgagttgggggcggatatttatcggggattggaagcggttcgcgtaggttggggatattcggggttagggcgggtcgtttggggtgggagagtatagtgaggaagtttgacgtttaggttaggaatttagggaattcgggtagaaaaggtgagggggtgggacggtgggcggcgggtgggacgttcgg

SEQ ID NO: 11476 - DNA, 1431 bp, Artificial Sequence
  Description of Artificial Sequence: Synthetic polynucleotide
cgagttacgttgtttttttgggagtttatcgtcgaaattaaagttatttttcgtcgggagtaggtaaaaggatgaggggaaagaaaattaacgaattatttttaggaattgacgtttttgttaatgattcggaagaaataaacgtagttttttcgtttcggttttgggttagtttacgtgatttttttgggaggttaaagagtatcgttttgttttttttgttgttaagttaagttattttacgcggcgtagtttcgattttttcggtttcgcgtagttttttttttaaattcggagaataagttttatttttttcgaaatgagaatttttttattggttcgaatgtgtagtttattaaattaaaggggcggggaatttttgtttttattggtttttttttttcgtaattttcgttttttgttgagcgagtttagtttttttttgagtttagagcgttttttattttgtcgggcggtttttgattggtggaagtgaggtaaggttgggtttcgttttttttttcgttcgttagtaggttggagtcggggttagttttggtatttttttttagttagtggttaatttttggtttagtggggattgtgttcgtttttttcgtttttttttagtttttttttcgttatcggaacgagtttcgcgtttggtaggttgaggaggagtaaagaaagtaggattaaagagaaggaagatttggttaggtttgggtggcgtttgtagtgttagaaagggaggcggtggcggcggcggttgcgattacggtcgcgcgggacgtgaggttcgagagtaatcgacgggtagcggcggtcgttttagcgtttcgtatcggggtcgttagttagtagaacgcgagtttttgtggaggagtagggtcggcgcgaggcgagattcgggagcgtgagcggggtttttggggcgtcgtcgttttttttcgtttcggcgtcgggggttgtagttttggttttcgtttttttgtcgggttagtttgtaggcggagagagtcggacggcgttcggagcgcggatttcgttttgtggaggatagcgcgtcggttgcggttttttttcgattttttttgttcggcgtttcggttcgggtcgtttaggtgtaggtgcgtgcggtttcggggtttggggacgtcgtagttcggttcggggagggggcgttaggtcgggagtcgtagcgcgggagggacgagttcgggtcggcggggggaggggagcgggaagcgtttttgttgttggcgatcgggattttttttcggtataggggaaaggcggggaagttattttttatcgggtttgtgtttttgagaggattttttgatggttgcgtgaaggggagcggtaggatagtttttgcggttcgtggagcggtcggagttagggggtgggggagggaggatcgatcga

SEQ ID NO: 11477 - DNA, 588 bp, Artificial Sequence
  Description of Artificial Sequence: Synthetic polynucleotide
cgatttattttgcgagttcgggtgggagttttaggtttgtaggggtcgcgtggcgttatttttcgatcgcgatttttaatggcgagttcgtgcggtttttagtgcgtcgtttttttttgcgggtcggtggggtttgcgagaattcggggttgggggcgggtttggtagtggcgggcggggatttcgggtcgggatcgagaagcgttttcgaacggtagttatattggggttgtttagtggtttgagtttttttttgttttttttttatatttttttgttttggcgcggggggttttcgcggcgtcgaggtttcgttgcgtcgtttattcggagggaggagggtttttgggaggcgtcgcgtgggggcgcggttcgtggagttcgggcgttagggatcggtcggggtcggcgtacgggtgcgttttgggttcgttcgggtcgtgggagttagggagttagggagttagggatttcggttttcgtacggggtagataggggtagcgcgggcgattcggagcgtttgcgttttcgcggttttttttttaatagggtaaatttaggggtttgatttcgcgtttgttttgcgg

SEQ ID NO: 11478 - DNA, 1203 bp, Artificial Sequence
  Description of Artificial Sequence: Synthetic polynucleotide
cgtttttttgaagttcgttttttagcggtttggagttcggggcgtggtcggttcgaatttgttttttaggtttagaacggagttcgtagttcgtaattcgttgtggtcgtagcgggtcgcgtttttcgttttcgttttaggagcggtcgaggatttgtttagttgcgggcgttaagttttggtcgtattttttttttcggcggagggagtcggttggcgttgcggtttttaaggcgcgcggacgtcgcggagggtagttagtcgcgcgggagcgggtagcgcgcgcgagggcgttgggcgtcgtcgcgaggcggggaagcgcggggtcgcggcggtgcgggttttagggcggcggtcgtcgtcgtcgtagtagcgtttcgagcggggagggtcgaggaggttcgacgagttggggatggagagtatcgggttttttattgttttagagcgcgtgtgcggttttgggcgcgtatagtgacggtgacggtatttttggttcggtagcgtcgaggtcgtttcgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcgtggtttttcgggggcggtatcgttaggtgagcgtcggtcggggcgaggtcgggtttcgggcggtaggtacggggttaggtggttttgaaatttggcgtagtcgcgagtcgagattttcgattcggttagtcgttcgggtatgttattgtgcgcgtagttcgtttcgtcgtttgttttggttttgtgagggttgttgtgaggtttaagtttttggtagcgtttcgtttatcgatcggttgttgttgatttttttgtgtgttcggggtttatttcgcggttcgttcgtaggagcgtttgtatttaggttattttggatttaaaatagacggtattgtatcgtgtagattcgagggttgggcgt

SEQ ID NO: 11479 - DNA, 5370 bp, Artificial Sequence; identical to SEQ ID NO: 7304
  Description of Artificial Sequence: Synthetic polynucleotide

SEQ ID NO: 11480 - DNA, 1691 bp, Artificial Sequence
  Description of Artificial Sequence: Synthetic polynucleotide
cgagaataaacgttagtttttatttttgtggaacgtttaacgtagttggttgggggaatacgaggttttgtagggagcgagtttcggtttcggtttgacggaatataggcgacgtacgtgaagtttaggttttattttagcgtaggcgggtttttagcgatttatagttgttatatattcggttagcgtcgattttcgaaggcgtattttttatattttatttcgagtatcggttttatcgttagggaaggtttttttggatagtaaggtcggggtttaggatttgcgagatttattttattcgtttcgttagagtttaggagtagtaataggtttgcgtttttttcgggcggcgttttgtagattttcgacgggttaagggtgtttttagtttagtcgtgcgtttaggtcggggagatgggcggaggattggggttttcgatttttttgatagtttttgcgcgttagaaattgagtagatacggggttcgcgttatttcgttcgtcgtttgttttatttcgcgaggttgcgtttttattcgggttcgggagggtcggttcgcgtttcgggtatgaatggggtttttttttttaatagcggggaaatttcgttatcgttttttatttcggttttcggagttcgcggtggcgtaggtttgtttagtaagtttttgaatcggtagataaaggggtatcggaggaaaagtcgagcgtttttttaaatttatcggttatttttttttttttaaaataaaggagtttttcgtcgattttcgttttttttcgtaaggcgcgtcggtatttcggggagcggttatttcggggtattgtttaggtttttgggagcgcgtcgtattttagttcgagcgtcgcggggatagttggcgatttgtatttataggagttttaggggcgggtggagcgttcgggcgtttcgagtcgtcggtcggattttggagggttagcgcgggattcgttttttcgtagaagtttgcggatttcgcgttcggttcgtcgagttttgcgtatttatttcgtcgcgagtagcgtaatttgtggcggcgtcgcgcgttcggtcgcgtttcgaatttttttttagtcggtagttttcgagtttcggtcgtgcggcggtcgaagagggttcggcgtttcggagtagtcgcgcgtcgttttcgggtcgttttcgtttcgtcgtcgtcgagtttcggagagagcgcgggcgttggaaagtttcggtggcgaatggcggtttgagggcgttgcggcggcggcggggcgggggcgttggcggtttttcgtttttaagcgcggagtgggggcgttgaggcgggtgcggcggcggcggcggcggtagcgggagagggcgggatagcgggagggattggtacggatagtgatttttacggggagttgtcgcgagcgcgcggattttagttaggaggatcgttaggggttcgttttcgtcgtcggttttttttttacggtcgtgggaggggattcggcgtattattcggtttcgtttttgcgtttcgggggagtcgcgtttcgaattagttttttttttacgagggtagggatttcggttttgtttttttttcgcggtttttagtggggattcgcgttttaatttagtttttgttttacggtcgggggattagcgtttttattaagttcgtttcgtttttttacgt

SEQ ID NO: 11481 - DNA, 1223 bp, Artificial Sequence
  Description of Artificial Sequence: Synthetic polynucleotide
cggaatgttatttgtttcgattgttttcgggtggttataggcgcgggggaaggcgtagggttaggggcgttgagggtgaaacggtttcggcgttcgggcggcggcggtggtcgtttgcggtagtttagttgaaacgtagcggaaattgtagttagttacggggttgcgggaggtaaggtaggaaggtggcgttgtcgtcgagcgtttggagttcgagcgtttattatggcggtaagggtaatggtcgttacggggagcgagtacgttttttcgcgcgtatacgtcgtcgcgtcgggttttcggggttcgttatcggcgtcgttgtcgtcgtcgttcgtttttttatttttttttacgggttgtagcggaattttttttttagatatcgtttttaagatggcggttttttttttcggtaattttttttatcgttttttgtagtaggcgtcgagtcgtcgttattttgtttttcgttttttttttttttttatcgatatttatatagcgaaaatcggttcggtcggtttgcggtttttattttacgtttgtagttttcgttttttcgttaggttttatttcggcgcggtgttttaggtcggtcgcggagtcgattcggggtttttcgatcgttttcggtataatcgggcgatttttttttaattttcgttcgtttacggagcgcgttttcgtcgtcgttcggggtagtcgggttttttttcgggtttaattgcggttttttcggggtttgttcggcgtcgcgcgttacgtcgttcggtttagcgcgggagggcgttttgcgggtcgtcgattaggtcgagattaggtcgttgtgcgcgtattaggtttcgcggtcgcggcggtattcgggatttatcggacggacgtgcgggcggtcggcgacggtggcgggtgttgtaggtcggtttttttttggagtattgggtcgggtttcggttggtggggcgggcggagggagggaggaggggtcgagttcggagttgataaaaagcggtttagtttttcggtacgggttcgtcgttagtacgttacgttatcgttcgggagagagatttaggaaaatgcggaagggtagataggttttttttttcgttcggtgggtttttttggtatttcgtgtcggcgtcgttttcgtttcgcgatcggggagtttagtggtttcgttgcggcggggttttcggcggtcggagttttcgtgatagcgt

SEQ ID NO: 11482 - DNA, 1103 bp, Artificial Sequence
  Description of Artificial Sequence: Synthetic polynucleotide
cgaggtacgtattaggggggatttcgtattcgtagtttttcgtttcgtatttcgtagttcgggacggtttttggttttcggttttagcgaggtcgtcgaagtcgtagtatttagttttggaaggttaggtagtcgggatcgtagggattagtttcgagcggcggcggcggcggggtagaagggtagtcgttttttcgggatttaggacgtcggcgggcgggaggtatatacgcgcgtataagcggaaagaaagcgggtttattgcgtggggatgttcgttcgcgtagttgtttcggcggcggcggtcgttgtttgtatcgaggtcgaggcgcggcggtggcggcggcggttgcggattgagtttttttcgtcgggcggtggatgtagggcgcgggaggggcgcgaggggaggggtgcgcgtttgggaggcggggagggaaagaggggaggaagtaggagcgcgggggcgggcgcggttagttaggggcggggcggggcgcgcgcggggtcgggttttgtttattgtacggaggttgtgtgcggggcgcgcgcgcgggagacggtcggacgggcgtggggagaggggcggtttgttacgtatttcgcgcgtttacgtgttttcgttattggagagggtcgggtacgcggagagggtggttgcggggacgcggtggtaggttttttttcgaggatcggttcggattcgaagatcgggaggagggcgggtcgggggcgtttcgggttttttttttcgcgtagcggtttttagaggtttgcgggagttacgaattattgtaggcggttggggttggggaggtgggagtaataaagatagttaagtgagggtggcgtttcgttttatcggggttttcgttaatttgcgtattttttgaaaagcggtttcgtttcggggtttacgtcgtttcggttttcgatttcggaattcggtggtttgtagcggcgtcgaaaggtttatcgacgatttttttttttagtagtaagtcggagggagttaaataagttttatttataattttagtgttattatttagagcgttttaacgttatttagaaagtatcgatggtaaagcggcgcgtggcgt

SEQ ID NO: 11483 - DNA, 616 bp, Artificial Sequence
  Description of Artificial Sequence: Synthetic polynucleotide
cgtatttaatggcgattcgatagttttatttggtatcggtgttcggttcgtggggcgggtggagggtcgggtagtcgtagggcgcgggttttttcgggtggacggtgttcggtcgggtcgggtcgggtcggggaggtaggcgcggggcgcggggcgcggtgtatagcggggagcgcgtagggaggcgaggaggcgcggattgggtttcgttcgtaggagaataaataggtttttttcggtcgttcggagtttcgtttttcgttttttttttcggtcggtttttttttttgttttttttggggtaggtagaggcgtttggtatatttcgtatattttttcgttagcgtttttcgttcgttcgttttttttcggtttcgtttcgcggggttgttggagaaattaagtttggggttttttttgtcgagtacggggcgagttttagaaggttttgtcgtgatggaaaatttttaggtaaattttttcgggttcgtggtttttaggtcgggaagttttcgttacgtgaagggttttcgtttttagttgcgcgatttggtttcggtatagggttaacgatttttatagatgttgtcgggttaatttagtcgagaattatcgt

SEQ ID NO: 11484 - DNA, 206 bp, Artificial Sequence
  Description of Artificial Sequence: Synthetic polynucleotide
cgttaaaggcgacgtgtcggtcgttagttttaggtcgagtttcgagcgtttgtaggaatacgtttttttattcggcgcgggacgtagagttgcgagagaattttgtttagcgcggatttaacgttagggcgtcgtttagaggttggtttttgtttcggttttattcgtcgggagattatagagttgtttttttagtcgttcgtcgt

SEQ ID NO: 11485 - DNA, 1141 bp, Artificial Sequence
  Description of Artificial Sequence: Synthetic polynucleotide
cgtattaattggcgtgtgtaggcgttgttgtttcgcgttgcgtacggagaagcgtttcgaatttatcgtacgatgcggagttaggggtagcgagtgagcggcggtttttagtttttttttgttttttttttgttttttttgggaatggtagggggttttttatgataaatgttcgtaaataggatagggttcggacgattttagagtcggcgttttttttttatatttttagttttagggtcggattcgttttcgcggttgttatcgtttttgtttcgggcgtttcgcggggattatttcgttaggtgagcgtttttaggagtttttttgaaatttatttgcgtgaagtataagtttattagcgtgagggtgaaaaattgtaggtatatagggaagtagtagagtagttagaagacgaaggggttgagcgaattggtcgttacgaagtttttgaagtagaaggagaagaggacggttcgtagggaggtttagaagaggtagagaaagaggaagacgttttggtagttgagtcgtttgtggcggtaacgtagtattagttagagttgtacgtagatgaatacgaagagtagcgcgtagaatacggtgtagacgacggtgaggttaagttttacgtaggggggtacggtcggggttagcgtgggcggtagcgagtcgttgcgggttgggttttacggcggggtttttatcgggtcgggggcgttgtcgcgcggtcggggacgttcgggttttatcggggtttacggtcgtcgtcgttttcgcgggggttttcgcgtatcgcgtttagtttgtagtttcgagattggaggaaagaaaataagtcgtattttttttttcggtattatatgatttattgggacggtttttgtttgcgattggtagcgtcgcgttcgtcgttttcgcgcgtcgatcggtttcgcgcgttttcgtttcggttcgcgcgttttcgtttcggttcgcgcgtttcggttcgttttttttcgggtatcgcgcgttttcgtttcgcgaatttcggttcgttttattttcgttatcgcgcgttttcgtagtgcgcgtttttagagtcgtacgttttttttcggttttttttttattttcggggtcgcgcgtttttagattgcgg

SEQ ID NO: 11486 - DNA, 1819 bp, Artificial Sequence
  Description of Artificial Sequence: Synthetic polynucleotide
cgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgt

SEQ ID NO: 11487 - DNA, 1813 bp, Artificial Sequence
  Description of Artificial Sequence: Synthetic polynucleotide
cgagtttattttattaacgttaaattcgttagtttcgttagtcggttgtaggatcgagggagggtgtaaaaggcggggggcggagggggggtagattagattaggcgaaatttaataagtttttagttttttagtttaaagtttttattatcgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcggtttagtggtttttgcgcgtcggagttcgtcgcgaagattgagcggtcgcggggatcgtcgcgggtttcgcgcgtatttttgggtttaatattgttattatttgatataataggagtagtgtcgggggggtattgcgcgtttagacgtgagttgtgataggttttcgaaattgggcgt

SEQ ID NO: 11488 - DNA, 1872 bp, Artificial Sequence
  Description of Artificial Sequence: Synthetic polynucleotide
cgtggatagaaagtacgcgtaaggggtttcggggataggaagttattagtttggggagcgggaggtattggatattttttcgtttcgcggtcggtacgggtgcgcgtgcggtagcggcggtaggggtttttcgttttgttcggggttttcggtcgtgtttcgtcgttcgggtcgcgttcggggttgattcgtattattttgtaaggaagtgaacgtttcgtacgggaaggggaggcgtttgcgtcggtcgtcgcgtagtttcggggacgttcggggttgtcgtcggttcggggtcgtagacgatcgcgggacgcgcgagtttttcgtttttttttgttcgtcgtttttttcgttatttttgttcgagaggagttaaattcggtttttagagttcggggagggtggggatattcggtgtttttttcgcgttaggaggaagggggagggcggagaggatttttggttagtttgcgtcgagtagatttaaattaaaataaaaagattaaaggagtagcggtcggggcggtagcggtttttaggtcgggatattcggggtggtgcgttcgggtttgcgggggttgcgtcggcgtcggggaggcggggggagcgggagcgggcgacgcggggaaggggggagttagggggagggcgtcggtcggaggaggggcggattcgttcgttttagtcgagtagagtatagtcgagtcgagcggttcgggcgggggtcgatttcggttagcgtcggcgtagagagcgggcggaggcgtaggttatgttgcggttggtgtttatcggggttcgggttatcgtggatatgtcgtacgttcgttattttttggatttttagggtttcgttattttttaagttatgtagaagttggtggtgattcggttgagttttaattttcgcgaggtcgttattttgagtcgggattgttcggtgtcgtttttcggggacggagattttttcgttcggaatcggtgagttcggcgttttttaattttacgttttcgttttcgtttcgggttcgcgtcgcgtcgcgtcgttttcgtagtttttagttcgttcgcgtgtttatatttcggcgcgcgttcgggcgtatagtttgagtttgcgagatttcgggaagttgaattcgtcgttatttggcgaaggcgaatgtgatgtgattgttgttggtgtgaatattcgatgttatcgaacgtttttataattgagggttattttaatttgggatttttttttttttttttagtttttttttttttttttttcgtttttgaaataaaatcgacgggatttagaaggggaggtttttcgtcgggtcgttcgcgcgtatttatagtttttgcgttgatataatttttagggtggagcgggagtagtttggacgtaaattgcgacgtttaggtaaacgtgtttcggaggaaggaggttgggattcggttggttttttttgttttttttaggttggtagtcgtttcgtagtggcggagtttgtcgttggatgtgtgggtgtgtatttcgtcggtgttgtttgcgtgttgttagtgtagtgtgattgttgtttgttttttgagtgttaacgatcgtcgcgtggcgcgtgtttcgggtagttgggttagggtcggggtgggggtatggttgtttttgtcggtacgttttgtagatatttaggtgatatcgggttgttgcgagattttttggtttttttatttttcgcgttttttatcgtcgtgttttcgttttatttatttttagtaattggcgaagtaatagggaggaaacggattttattttttatcggagttatgttcgtttaggtttttgtttcgtgggtttttggttgttcgatttgattggtaaggcgt

SEQ ID NO: 11489 - DNA, 652 bp, Artificial Sequence
  Description of Artificial Sequence: Synthetic polynucleotide
cgttttttcggtggagacggcgacgtggtttatacgcgagtttttcgtcgaggatgaattattagttagttcgagttgttatattttattttagtatagttatcgcgagagtttcggggtcgcgtcggcgtgttttacgtacgcgtagtttttcgcggggtcggttagtggtgtcgtcgaggcggggggagtggtcgtcgcgtcggtcgagtgaggtagggttatacgtaggcgtattcgcgcgtcgatagttcgtgtatcgtgtggtagcggttgtgcgcgtttaggaaggatatttcgttttcgtaggtcgtcgggcggtagtagggttgcgcgcgtattcgttttcgtcgtaggcgtcgtcgttggcgtagtcgtcgtagttcgaggtcgtagacgcgcgcggtagtttcgtaggcgtttgcgtagtagcggaatagtatcgtttcgtcggacgcgtagtttaggtttagttcgtttacgcgtatttttagttcgcgtagttcgtaaggtcgcgtttttaatcgcgtacgcgcgcgtcgtcgtcggggtttcgttcgacggcgcggatttgggggtcgtttagtttagggcgttagttcgcgtagttttatcgtattcggggttttttgtaggagtgtacggtttgcga

SEQ ID NO: 11490 - DNA, 722 bp, Artificial Sequence
  Description of Artificial Sequence: Synthetic polynucleotide
cgtttttcgtagcggtgtagcgcggtcgtatttcgtattcgttgtttggtgtcgtggtcgttttttcgggtagtttttcgggttcggcgttggcggtagtggcgagcggcggagattttttttcggggtagtcggtgttcgaattgatcgcgtagttgttgcgcgttgagttttattttgcggcggtcggacgtttcggcgtagggggcggcgcggcgggcgcggtgttgggtatcgataacgtgtgcgagttggcggcgcggttgttttttagtatcgtggagtgggcgcgttacgcgtttttttttttcgagttgtcggtggtcgattaggtggcgttgttgcgtttgagttggagcgagtttttcgtgttgaacgcggcgtaggcggcgttgtttttgtatacggcgtcgttattggtcgtcgtcggtttttacgtcgcgtttatggtcgtcgagcgcgtcgtggtttttatggattaggtgcgcgttttttaggagtaggtggataagttgggtcgtttgtaggtcgattcggtcgagtatggttgttttaaggttatcgcgttttttacgttcggtgagttacgtttcgaagagggtcgcgggatggggggatttaagggaggttaggaggagggcggtttggatttagatttcggtttttatagcgtttcgttcgttttttaggtttggggttttgtacgcgtcgtgagtgaacgt

SEQ ID NO: 11491 - DNA, 858 bp, Artificial Sequence
  Description of Artificial Sequence: Synthetic polynucleotide
cgttcgatttaggtttcgagtttttttttcgattttttttagtttaaaggttgtattcgttttaggtttttttagttcggttttttagtttttttttcggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcgttgtcgggcgaggtcggtttacgtggagtcgggagtttgaggtttttgtacgcgggagttgcggacgatggtggttagtgttattgtttacgacgttattgtggtgtgtgtgtgtgagagacggagattttagtgtgtgtcgtgggtgttgtttgatcggatttaggacggtgagtaggggcggggtttatcgtgtgattttggtttacggtgacgtgatcgt

SEQ ID NO: 11492 - DNA, 598 bp, Artificial Sequence
  Description of Artificial Sequence: Synthetic polynucleotide
cggagatacggttatacgagtaattttagcgacgtttttttcgcgcgtgttcgtttcggtatttcggatatttttattttgatagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagcgtttcggaggtttttgggagtgttcgttcgttcgcgtttagtgcgtaggcgttagacgtttagggtttgcgagagcgagttgagtggttttagggtttatttttggtaggagagagggtgggattcgtcggttaggtaggtgcgggggaggagttggggtcggtgcggggattcgtcggaatttcgg

SEQ ID NO: 11493 - DNA, 1281 bp, Artificial Sequence
  Description of Artificial Sequence: Synthetic polynucleotide
cgcggtgtcggcgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcgtttcgcgatttgttcggttgttcgcgttgtcggcggttgttgtataagtcggtgacgttgttttgcgggtttatagtttgtaagcgttgcgtggagttagggttcgcgcggtcgtaggtgcggcgcgtgaacgtggtgttgagcggtttgttggagaagtgtttttcggtcgagtgtcggttgcgtaggttggtaggttaggcgcggagtttgtagcgttagtagtagtcggaggtcgcgttgtttaggtgcgattaggttttggagttgggtgagtcggttgcggggcgggttcgttttttttatatttgttcggtttagtagcggggtggggagttggtcggtgggttcgaggttttgggttttcga

SEQ ID NO: 11494 - DNA, 1788 bp, Artificial Sequence
  Description of Artificial Sequence: Synthetic polynucleotide
cgatgtagttcggagagagtatcgttcgcgtagcgacgcgtatagatttttttttggagacgcgtttttcggcgcgtgcggtcgagttcgcgtgaaatgtatagatttttcggtgaggttttgtttacgtgtgattttgagtattgcgaagttttttttttttattttcgcgtggttatttaaagttttgtttatatttcgtacgtgtagatgttaattttatagaaatatatgatgtaaggatagaaatgggaacgattggaggttgattttttcgtgattacgtttcgttaacgcggtgcgtttatgtatacggcgagtaaacgtatatagtcggtaaatagttatttttattatgtttagtttatagttacgcgtggggagaaggtagcggagagggcggcggtggtaggagaagtgggaagtcgcgcgttcgcgtgggttgttttttgatagttcggcgttgttttttttttttttcgggaacggcgtttattcgggggtcgtaggtttacgcgtcgggcgcgttcgggggggtttcgtagcgtcgagaacgggataatgaggacgcggtgataggttgggtttttgtcgcggtagtggcggcggcggtagttggagttgttcgtgtagtttttgtcgcggttatttttattttcgttttttcggtttttatttacgtttcgagggtttttttgaattcgaagatttttttgatgtttttagtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagagttttagttttttcgggagttggaaacggagtttagtttgggggcgtcggggttttttcgttttcggcgggagggggcgtttttgcgtggttcggaagcgtcgggcgggcgggggtgcgcggcggtcggatgcggggcgtcgagggcggggcgttttttcgcgttgtggtttgtggttcgggggattcgaggggtaaggcgtggggtggggggggtgggggtcggttgttatggcgacgggcggcggcggcggttgggatggaggcggaggcgggcgggagtttattcgtattgtattaaatcggttttacgttagtttcgggatagattcgcgaggagtaagtcggggagtttttgggcgggtacgcgtaggacgcgttagtagttgtttcgtggtttttttgcgagtaaaattttcgggggtgtttggtagtcgcgcgggcgttttggtgttgggttggagcggtcggcgggtttggtcgg

SEQ ID NO: 11495 - DNA, 626 bp, Artificial Sequence
  Description of Artificial Sequence: Synthetic polynucleotide
cgtgaggattttttcggtatcgtttcgcgcgggtttttgtttcgtgtttaggcggaggcggggtggttattgtttttttttttcgtttcgcgttttcggcggttttttcgcggttttttgcgtcgcgttttttttaggaggcgttttgatttcgtatttcggttttttatttttcgatcgttagttttagggtcgtcgcggcgacgcgcgattttttttttttgaggggcgcgggtttcggacgcgtcgggttttgttaggtatttagtggagggtcggaggtcggcgattagttcgagtttagtcgtttcgggagttggcgcgagtgtcgttacgattttttttgttttttgcgttcgcgttgttcggtcgtcgggcggtcgttttagtttttttatatagttttttaaaaatagttcgtttcgtatcgttttgtaaggtagtagggagattcgtagcgtgttaattcgcgttcgtcgttagggttaagtttcgttttaggttttgtttcgggttttttattggtttttagtgattttatgagttttttgtttattttatatggttatacgcggtttaatggacgtttttttcgagattttacggttgcgcggagaatcgaacgg

SEQ ID NO: 11496 - DNA, 1037 bp, Artificial Sequence
  Description of Artificial Sequence: Synthetic polynucleotide
cgggtttgattttcgcgtttcgttagtaatagttttttttgatttggtttaaggtttcggttttgtcgtttttaaaatcgttcgtaaggtttagtcgttcgtcgggttttttcgttgttttttaagttttttttaattatttgttttagatcgcgttatttgtaatttgtttcgggttggcgttatattcggcgtttcggcgttttttataagtgttttcgtttatgattagcgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcgttggttgcgggttttgggggttttttgtttttttcgggtttcgttttttcgtatttttttggtttgattatgatttttgaaggagaatacggataattcgcgggtttgggtaggatcggcgtggcggtggagaagagcgcgtgtttttgtttgtttttagtttagttcgcgaggatttcgt

SEQ ID NO: 11497 - DNA, 977 bp, Artificial Sequence
  Description of Artificial Sequence: Synthetic polynucleotide
cggttttggcgttaattcgtcggtttttggttttttggttttgttatttttggcggggttgtgggtcggtttaagattataagagggtttcggcgggaattttcggtggtgttcgagggatttaggtaggtcggcgatttttttttaatatattttttgaagttatcgagacgttttgtatttgtcgcgtttttagagtttgtcgtttttaggttttagttttgaggttgcggtgatatttattgggtatttcgggttttgtacgtttcgtaggtcggtcgtaggtagtcggttttgttgttatttttttttttcggtcgttggttggtttttttgttttggaggtatagagggatcgggcgttgaaaggtgtagttttgtttgtggagggatggatattcggagttgaagatagtataggagagaggggatttttatttattagtgaaggcgtcgttagggcgtttgtttttatgttttttttagatttgtgatatcgtcgtgcggtttagattttcgggggcggttgtatgttagggagggagtattttagggttttttgtttttaagggagagggatagtattttttcgggtttttagtttttttgggtgtggcgggagagttttgggcgaggttgcgtttatatttgtatttcggtcggttttttcggttgatttcgttttggttgatttcgcgtatattttttttttagcgttgtaaggatcgtttgaattcgttggttatttcggtgatgaattagtggttcggtgtgaagttgcgggtgatcgagggttgggacgaggacggttattatttagaggagtttttgtattatgagggtcgcgcggtggatattattatattagatcgcgatcgtaataagtatggattgttggcgcgtttggtagtggaggtcggttttgattgggtgtattacgagttaaaggtttacgtgtattgtttcgttaagttcgg

SEQ ID NO: 11498 - DNA, 6206 bp, Artificial Sequence
  Description of Artificial Sequence: Synthetic polynucleotide
cgttacgttatatcgagagaagcggagacgatatttttattcggtgggggcgggggcgaggtttttttagcgcggattcgggttcggggagtgtagggcgtattttttttgtgggtttttaagcgaaggtatagttcgggggtcggggtggagggcgcgttttagtaggtcgggcgtacgggtatttgtaggaggattatttgtttgttttcggatgggtggtatttgttgatgtgtcgcgtaaggtcgggcgagttgtagaaggtggtcgggtagtatttgtaggggaatatttgggcggcgtgtagtaggcgtaggtggcgtttttgagcgtttttgttggcgaacgatttttcgtatattgggtataggtggtattcggcggacgtatttaggtttagtacgtcggttttttcgtcgtcgtcggtcgttttttggggcgttttttcgtcgggttcggggtataaggttagtaggttttcggtcgggggcgttagcggcgcgtttttggtttgtagcgtttggtggtgcgttagtaggtgtttgcgtaggtaggtttggcggcggaattttttggcgtagtgatggtattcgtagagttcgttttcggagttcgattcggatacgtcgtcggggttcggcgtgtttcggtcgttgtcgtcgtcgggtgtttttcgcgttttagttttggttgttgtttttggtttcggcgcgcgggcggcggcgggcgcgggtcgcggtttgtgttagcggcggtgcgaggttaggttggtcgggtagttgaagattttggcgtattcgggatagcggtattttatacgtacgatgcgcgagtatttgtgttgcgttagcgcgaacgggtcggcgtatttttttttgtatagttggtagatgaattcgtttagcggtcgcgtcgcgtttttcgcgcggtttcgcggcgtttttatcgggttttttttgattttgagttttagtacgggcgacgtggttatttcgttttcgaagtgtagtttgcggatggttttgggttttttggcgttcggggttttgattgttttggcgggcggtttcgcggcggtagggggcgggggtcgttttttcgggggtcgtagggcggcggtagggggtagtggggggtcggggttcgggtcgcgggtcgtttcggcgttagtcgagaacgtcgtgtttattttgagttcggcgggcgcgaagagtagcgggtcgtcgtcgtaggtgtcgttttcgttagtttcgttcgcgtcgtcgtcgtcgtttttttcgagtagcgcggcgggcgtggggaaggattcggtcgagatcggcgagtttaggttgaagttgcgttcgaagtatttgtgtttttcgtgttcgcggtttacgggtcgcgtgggattgtagagcggcgcggggtgcgtagtttcggggttgtcgaagtgcgcggttcgcgggttttgcgggggtggttgcggtttaggcgcgtaggtaagcgcggcggcgagcgttgtatgggcgcgtttcgcgggcggcggcggcggtagcggttcggggatcgggttcggcgtcgggggttcggcgcgggcgttttcgtagttgggcgagagtagtagtgcgcggtcgtcgttttcgtcgtcgcggattcggtaggaaacgggcgtggattttttgttgcgttttattaggaagtcgcggggtatgttggcgcggttcgagggtacggtattggttcggtttttttttcgcgttcggtttcggcggtttttagtgttttcggtttattgttcgggcgcggcggttgcgggattcgcgtggcgtcggcgacggttcggtttagttttgcgttttgtacgcgcgtttttgttttcgggttcggtagtcgtttttttttaacggggggagggggttattgttttcgtttttcgttttttttggagttaattagcgcgttcgtagttttttagtttggtagggtgggagggcgatggggcggttaaaagggggtcgggattcgggggtcgttcggtaggtgcggtagatgtatttgagggcgcggggttttcgcgcgcgtttttggtcgtttcgttcggcgtcgtcgtttcgttcggtttaggtatacgttcggtttcgtttttttttacggtttgttgtttttttatggggaggcgtacgtgtttgggttttgtgtttttttttcggggggcgcggagtcgttaaatgggttcgtttattagcgcgataatgtacgtttttttttcgcgcggggattattcgcgggtcgttagtaaaatagtaataaaggagaagaatggttttaaatatgttaggagggtttaattcgcgagtcggagtcgagggggaagttgtgcgcgttgattgggtgggggcgggggcgcgtcggggcggtgcgggggagatcgttgcggaggcgtagtggtttcgcgtggtgtttgggaaataaataagaattcgagagagtagtagggttcggacggttttcgttcggattttggacggatgggtcgttggatttaagaggttaagtaaaagggtttttcggggttttaagtgtggatagggggttcggttttttggtagtggtcgagggcgatgtttgtgttcgtagttttcgcgcgtttacggggttagagaaggtttttttcgagtttgagaaggaattggtacggtttttttagtttttcgaaagcgcgggattggagcgcgggcgggttgggttgggtttttagaggaacgtgaatttttgaatttttgggtttttggaggtttgggaatggtatttttggcggggttcgatttaggtcgttcggagttttcgcgtggtttaaggttcggttaattcgggtcgagttggtcgaagttcgaaacgcgcggtcggtttcgtgcgttttagtgaagttggttttttttttttcgcgcggttttatgtatttttatttcgagcgggtattttgtttgtcggttgatattagatgttaaattaagggttttaattaaggcgttgcgaaataaaggggttgtttgtttgggcgtagtttttacggagtcgtgttttttttatttttgtgaaggaaattaattttttgttattgagtttcggtcgcggttaatttggacgtaaaagagacgcgtgttggacggggggagggggggtaatttgtattttgaggtaggttgaggttttcgagaggataagtcgttttttttgtgttattaggaagagataatagcgaagatttttttcgtttttatttttatttttatttttgttgtcgtttcgtttggatttagattgggtcgtttgtttttattttttgtttagtttagtttcgaggaaatataaaaggtagaattttcgggggatagggtagagaattttacgagtgcgtagtggttttgatcgtttaatattggggaataaatagttaagttatataaaatgttatatgttgtgaggaaaatgttattttattgaaagagaaggaaatatttttttgtaaagttttgtatattagatagattttgttgagttttatttacgtttaattttattgaaggtatttaattgttttggattttttttttgaaaatattttggcgtagaaattaaatatgtaaaaatagagtttatatgagttataagttgtgatggggatagttgttaggtttaattaattaaggggttaattaggttggttaattaagggaaagatatttgataattttatgtttgtaatattttaatttatatattgaaaagggaagaatgtatatagtgaaatatattttgaaaagttttattttagttttaaaaatgttgtggtgagtgttagtttttttaaaagttagaaattttaaaatgagtttatttaaaatttataaatatatttttatttaaaagtaattgatgttatttttttgtttttttgagttttgattaatagtgttgatgaaattagaagtgggaaaaggatttcgagatagttttggttaattttattttttaattacgaattttatttggattgtagaatagtatagggcgggggttcggtttgttttattcggttttgtatatgtaatattttttttatttaatagataatagagagttagttattttgtgaattttttaaaaataataatatttataattgtaaataagtcgtggggatgggaaatcggtatttttattaataaaaaaaataaaataatttttgcgtgagtgaatttaaatagggttttgaatttagttaagggaatttattaaacgttattgagatattgagatttaatgaattcgtttttttttttttatttgtggtttttagttttgttagcgtaaatgaaatttgtttttagacgggtatagttaaaataaatggaaatttgaaaggtattagtattggaaattaattttattattcggggttggaaggagttaggttgcgtacgcgcgtacgtatatattagcgatttttaagtaggtgtagtttagttcgggtcgtggatcgtagtcgttttttgcgtgatttttttagaatttgtgtattcgtatgtatggggatatcgggtcgagatatttgttttcgtttgggaagagtaaagcgttattatagtgcgttttcgacgtcggttttggcgtacgcgattcggagaatgggtcgcgtgaagttaagttgggggaaatagcgcggatttgtttttttttaggggggtttcgcgaaagttagtgaatataaggatttaaggtagagtatttaaggggtttttttcggttttaggtgatttttttttttttttcggggttttggttagcgttttggaaaaatttcgggtttttttatttttttttgcggatttcgcggtgggtttttttttcgacgattgcggagttcgaggttttaggttttttaattttttttattttggtgtgcggggatgtcgtcggggagcgcgtcggggtttattttgatttttattacggttggaaattaaagttaaggtaatagggagtttgtagaaagcgcgaagtttggaaataagagtagaagcggggaatttttgcggaggagttggttttttggggtgtttaggagaataggaggttttggttttacgggaggagtcgggcgggttcgtatttttatttcgtagagggtatcgcgtttggagacgtcggcgttgggggtgaggtgttagcgttttttattattattttgttgtagattttttttttggttttatagaagtttttattttcggtttttagtttttcgagttataatcggtaggaatcgtgcgttatcgttgtagtgttcgtcgttcggagggattagcgtttttttgcgtcgggtgcgttcgattcgagtcggtgagaggttttgtatttgtaggaatgaggggttgttgtgttagttttaggggtacgcgagagatacgcgtagttcgtttggtcgttatttcgttcggttcggttttaggtatttttcgggtttttcgttcgcgggtcgttgtttttgttcggcgtattagtataaagttgttagggatttttcgtttagataattttatataaaaggagagtgtatgaaagagagcgaataagggacgattcgcgaggttgcgtcgtgcgttttcgcggggagggatcgcgtttaagtattttttttttttcgagttttaagtgttttttggtaatttgttgcgcgtttattattcggtcgggggtcgacggcgtggttggttattttttttattttttcgagagtatcgtcggggttattgtacgttttttgaagtgtttttagggttgtttgtttttgttttagtgggatcgtcgggttagggagggaggagagcgggtaggaaggttcgggcgggcggcgggaagggcgacgtcggcgaaagttggtagaggcgaagtttagaaggtgagaaagttataattaaagaattaggttagggagagttaggacggtacgggatttatcgggatgatattgattttggggcgtaagaggtgttttttatttgtgaggtgttggcggtcgttagttcgtgcgtttcggttttaaacggaattgataaaatttagcgaaattgattagaaaggttgcggcgatttcgattttttttttttttttttattttatttatatttgtatttcgtttcgtttgtcgtaggaggacga

SEQ ID NO: 11499 - DNA, 574 bp, Artificial Sequence
  Description of Artificial Sequence: Synthetic polynucleotide
cgttagcgttaacgaatgtggggatagttcgtttggcgttcgcggtcgtatttttatcgggtagtttcgtatttttttttcgggtttttaagtcgttcgtttcggttgcgggagatttcggcgaattatattcgagaggggggcgcgtggggcggagttttttttttattgttttttcgttattagtcgtttttgtcgtcgagttcgtagtcgttagcgcgtttcgagtttttttaggttagaggttttcgtaggcgatggcggataagagggcggggattttagaagtcgcggcgcgttcgtcgttcggttttgttcgggagggggacgcgcgtacggttttcgcggttcgggttcgagaagttggggggcgcgggtttttttatttcgtagcgggtttcgggatcgttttttttttttttgggcgcggggaagcggtttttacggcgattatttcgagtttggaaaatggtcgggttcgggacgaagttttagaaatttgtggtgtagaggggttagggattcgggtaggagttagcgagaaggtcgaggacgcgaataaggaggagggcgt

SEQ ID NO: 11500 - DNA, 3438 bp, Artificial Sequence
  Description of Artificial Sequence: Synthetic polynucleotide
cgtgtttgtttcgttttggtcgtttgaggtcggagttatatatagtttgtatagattcgagatattcggtttcgagtgatttggaaacgagtgtgtttttattgcgtttaaataagacgaggatatttataaggtgcgagtttttaatttttagttattggtaggggttgcgtagcggtatcgtttaggttttttttttaggcggtcgatttatttttgcggagagtacgtttttcgaagagggttgtagacgcgtttttttagtatttaatttgttattttataagattgagttaagttttagttaaaatatatttattttattaaaaataggcggtttaatattacgtcgtattttagttttttcgagggcgtaagagaatagagagtttttagattaattggaggtaaatattttattttttaatatttaaaaataatttaggcgcgtttgtatcggtgtggtttacgcgatttttacgcgcgaggttagtcgggttggtttagcgtagatagcggtcgggatttatttatttagtgcgcgttttttttgtttttcgttgcgcgcgtttaaagttagaaagaagaaggtgacgcgggaggcgggtcgggttttcgggtttagcgaattcgcgatttattcggtttcggcgtttgagtcgaggttttagaaagaattcgttaattttagttattttggatttgggtagggagggtgcgcggtttttaagtttagtttggatgtttagtgcggtgtgtttcggttttttcgtttgtttttcggggaggttttttattcggtggttttgggtcgttttattgtggcgtttttatttttggttatcggttttttttcgtttaggatttttcggtttagggagtagtcgacgggtattttcgaacgttggggtacggaattttaacggggcgattagagcggagttcgcggttcgaggttcgcggttgagtacgaagacgggattcgaggatttgtatatcgttcgaggggaatttgttttgggttttggtgtatatatagtatgcgttttgggttggtttgggttgggttaggtaggggagatttggttgggtacgaggcgtcgtttaagtttttcggtcgtgggtcgggcggtcgcggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgttgcgttttcgtttttcgtttttttagttttttttcgtttttttttttcgcgtttggttcggcgcgtttcggtcggtcgtaaagtttttcgggcggtagcggcggttgcgtttcgttttagcgatggtcgcggagttgagtatggggttagagttgtttattagttcgttggttatggagtatgttaacgatttcgatttgtttaagttcgacgtgaagaaggagttattggggcgcgcggagcgttcgggtaggttttgtatacgtttgtagttagtcggttcggtgttttttatatcgtttagtatttcgtgtagtttcgtgttttcgtcgtttagttttagttcgatcgaatagaagatatatttcgaggatttgtattggatggcgagtaattattagtagatgaatttcgaggcgtttaatttgacgttcgaggacgcggtggaagcgtttatcggttcgtatttagtgttatagtcgttgtaaagtttcgatagttttcgcggcgtttattattattattattattattatttttattcgtattatgcgtattcgggcgtcggcgtggtttacgacgagttgggttcgtacgtttattcgtattattattattattattaagcgtcgtcgtcgtcgtttagcgtcgttagttcggcgtaatagttgtttattagttatttcgggttcgggtcgtacgcgacggtttcggcgacggcggcgggcggtaacggtagcgtggaggatcgttttttcgacgattagttcgtgtttatgttcgtgcgcgagttgaatcgttatttgcggggttttattaaggacgaggtgattcgtttgaagtagaagcggcggattttgaagaatcggggttacgtttagttttgtaggtataaacgcgtttagtagaagtattatttggagaatgagaagacgtagtttatttagtaggtggagtagtttaagtaggaggtgtttcggttggttcgcgagagagacgtttataaggttaagtgcgagaaattcgttaatttcggttttagggaggcgggttttattagcga

SEQ ID NO: 11501 - DNA, 4088 bp, Artificial Sequence
  Description of Artificial Sequence: Synthetic polynucleotide
cggttcggtttggttcgggatacgtttgtttcgcgtatatatagttagtcggttttgttcgaaacgtattaagtcgcgtttagcggtaatcgttttttttttttttttcgtcgtttttttttcgatttcggcgttacgatttttttgcgtttttttttttttattgtattatttttatcgtttcgatttttttcgaggggttgatgttattagtttttttatttttttcggttattttttttcgttaaagtttttttttggcgaggtttttttcgttattacggcgttttttagcgttattttttttttttttcgttttttttttttttttttttttttttttaataaattttatattttacggaggcgggtttttttttttttattcgttattcggttttttgttttcgaaattttttttttgtcgtagttttcggagttttatgggttttttttttttttttttaatacgtatttaaatttttggcgtcgtgtaggtttcgcggaaaaagagagaaagagagaaagagggggagagcgagagcgagagtaagagagagatattgagcgggtaggtcgggggagggggattcgcgttcgcgtcgttacggtttttcgtttcgtttttgagttttcgttcggtcgaattcgcgtttttgggtttttttttcggtttcgttttttatagatagagttcgcgaacgggcggggggttcgggagcgcgcgttcggggcggggggcgggttcggcgcgcgcggtttgcggggcgtttttcgagggttttcgggtcggggtcggcgtttttcgttcgtttttatttagtagtagtaggcggtgcgtggttcggtagatttgtttgtttttttgtagttgtttttcgatttttttgttggttttacgttgcgtttttttttcgttgcgttggttttcggttttattgttttcgaggtagtttatggcggcggcggcggcggcggggcgcggtcgggttgcggcggcggcgggcgcgggcggttttacgtgggtcgggagggtcggggtagcgtcgggcgggcgggtcgggcgcgggttcggtttttcggtaaggagcgcgcggggcggattgcgggtcgcgggtcgcggggcgcgcggacgggcgggaaggggagggtgtcggtcggatcgaggggcgcgcgtagtttttcgtttttcgagtcgaggtcgagggggttgatggtcgtcgtcgggtcgaggcggattagagtaggagttgcgggagttgttgtcgtcgttgtcgtcgtcgtcgtttttattgtttcggtcgggttttcgtcgtcgtttcgagttaaaagcgtcgcggcgggcggggggaggcggggggaggaggaggcggcggcggcgaggggggtggaaggaggaggaggaggaggagggtcgaggagcggtcgcggcggcggcggcggttgggagggcgggagtcggcggagggaggcggtttttcgggagttcggggagggggttttttcgttcgcgttcggtcggggacgggacgggtcggggagacgttttttatttttcgggttcgggtagtagttcggttgagtcgaggggggagagggggcgttttcgcgttagtgacgatttttcgtacgacgttaacgttttatttttcggatcgcgtcgttcggcgttttcgaggttttttttttttttcgcgggcgtcgtcgaggggttggggtgggcggaaggggagggagcgcgcgttcggatttaggaaaattttcgaaagagcgagagatatagagagttagagagtaggagtgtggaaaaagcgaggcgagtacgaattaaaggatagagtaatcgaaaaggaaaatgtgtttatatatatatacgaatacgaataaaaatttatattatatagcgatggtggtgtttggtggcggtggcggggtggggggtttgattagatgagtcgtttttcgcgttttcggcgtcgggcgttatggttcgagtcgaaggcgtttttggtttcggagcgttcgcggtttttgcgtttggcgcggtcgtttaagtaggagaagaaggcgtagtttaggaatattcggaagtagtaggtcgtttcgaatacgaagtcgtagtcgcggttttgtttcgtgcgtttttgtagtaggaagttgagtatttacgaggggttgcgtatcgagaagattaggaatattacgaggggtaggtgggcgtttagcgcgttagttttgagcggttcgggtcgttatacgatgtttttaacgcgcggcgtcgcgtagtaggcgtcgttttcgtcgttcgagttcgtgttttagttagtttaggttttattcgtgttttcggcggcggcgtttttttcggcgttttcgacggcgtttttttcggcgtttttgtcgtcgtcggcggcggtcgcggcggcggcggtttcggggtatcgggtttttttttgggtttttggtattttttttttttttttttttagtattttttttattttttttttttttttttttttttttttttttttttttcgtttttgttttagtagttttttttcgagttttttgcgttttttgtttgttaggaatttttcggggagcgtttttcgcgtcgggtttttggggtttttcgcgagtttttcggggttttcgttttttcgcggcgcgagcggttttttcggttcggttaacgtcgtagtcgtcgtcgtagtttcggtagttatttcggtagtcgtcgcggtcgtttttttttcgtttttcgtcgttcgggttttgagttttatggttatttttagtatggtggttcggttatttcggggagttcggttcgcgtttggttcgggttttttgtttgttttcggtttcgggttgttcggttttcgtgcgtttcgtgtcggggggtttggttgcggttttcgtcgcgttgtttcggggtcgcggagcgcggttgttcgggtttcgggttgttgggttggttgtttaagagttagcgttaaaaaggatgagtaaacgaaaaagggataagaataaattaaaaagtatttaataatagcgagaaattaaaaagtattaagaaatgttaatttaaaaagaaaagtgtaaaggcgcggatggtaggagtttgtttatttttaggcgttttttggtttggtttttgggtacgttaatggagaagagaaaagagagagaattggggggtgttcggaggcgtttcggggtaaggtagcggcgttcgggcgtttttgttttgtttcggattcggcggtttttgtttgcgtcgggcgattcgtattttcgcgggaggtttcggcgtttttcgatttatatgtgagtgaggtgtatttatacgtaaggtagcgtttgtcggtcgttcgtcgtcgtttcgcgtcgggataggggttcgttttagtcgtcgcgtcgtagttcggagttagagagtaggggagcgtcgcgtcggttagttatttgacgtagttcgtttcgcggtgtcgacgcgattgagtgttttcgtcggggagtagagtttttaatcggtttcgatgacgttttagtttttttagaggatcgatttatagtagcggtttttataaatcgaaggggaagcgcgaaaaatcggtttatcggggacgtatttaaatgggtcgtcgcgtattttgggggtgtaggtcggtgtcgggatcgcgcgggcgtgggtcgggggcgcgggggtcgcgatggcggggggcgcgggcgcgtttaaggcggtgggcgtttaatttcgttttttagatttgttttttaattttcggtgagtggtgtagttttgggcggcgtgtaaagtgtgcgacggcggcgtttatttttgttgtgcgtttttttatttttagttatttatttcgtttttttagcggcgcgcgttcgtcgaggtaggtgttagagagtcgaattcgaattatttgcgacgttcggacggagtttcgtattttcggacgagaaaagtgcgatgggagtgtaaagttttttttgttcgaagtagtaggcgcgtcggtgttacgggagtcgaggagcggtggtcgtggttgtggagtcggtgttcgaggcgt

SEQ ID NO: 11502 - DNA, 522 bp, Artificial Sequence
  Description of Artificial Sequence: Synthetic polynucleotide
cgatatagttttcggcgcgtcgggtattgaggttttggagtatagcgtggggggtttggtatagatacgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcgg

SEQ ID NO: 11503 - DNA, 2260 bp, Artificial Sequence
  Description of Artificial Sequence: Synthetic polynucleotide
cggtattcgggtcgaagcgtttggttcgcgttttcgcgcgggtttttttggaatcgtttcgggatacgcggttttttcgttgttggattttttttcgagttttagtttgttaggtagggattttttgggcgggcggcggggaagcgtcgagtcggcggtcgtttatatttttttttacgtagtataaaggatattcgtcggtaaatttttttcgtttttgattcgggtcgagtcgggaatttagcgttagttttgtttttggcggggttgaggttttttttatattttaggttatttggtaaacgttttgaggttgttattttttttgggtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggatcgtcgagagttcggtagattttttttaaggttttgattttaatatttttagtgttttgttaattatattttttgttttttttttttattaaggttatcgttaagatattttttttttttttttttttcgtcgttcgttattttttttgttttttttttggttttttttttagttttttgggtttttttttcgcgttgttttttagttttagttgtttttttcggtttatatttcggtagttttttttttttttcgttttcgggtattttttttttttggtcggtttttgaaatttagtaggttcggtttcggttattgtttttttttgtttgtttttatttggtttgtttttttaattatcgtttttttatatttttttttttttttttttggtaagggggacggggggaaacggggtattatattttcgtttttcgatttcgttattttttttagtttcgtgagtcgcgttttttcgttttttttaggttcgcgattttattttgaggttttttagatttcgtagggttttttacgttattaagtttgtttcgattttttttcgttgttttttatattttttgtcgcggcgcggtcggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcgggtcggtgtttttgtcgcgggaaggaggattcggacgtttaatttagcggcgaagtcgttttttattggaggaggtttttcgaaaacgt

SEQ ID NO: 11504 - DNA, 1502 bp, Artificial Sequence
  Description of Artificial Sequence: Synthetic polynucleotide
cgacggtgagcgtggagtagttcgcggtttcgttgttttttttattttcggatttttagtttttttagagtggaggggtaagtatatagtaagtatttgatattcgttcgatttttgagttttttatttgtaggagttagggggtttgtttttcgtacgttttttgttggagggaggaacgagggaaggagaaaatttacgttgaggtcgttggtcgattattttttttatttttcggataatattgatgggttttattaaggaaagtcgaattttcgtatgttcgaggagtgtcggaggtggttgtgcgtttagttttttttggtaaagggttcgaagtattcgtttatttaaaggcggtcgagagttatattatttgtttgtatgacgggagatatcgaaacgttttttttgaacgcgatgataaatatttttttttatttagtagcgacgtgtacgtgatagtttttgggttttcgtaattacgtggaaatttggaataggtttgcggttgtatatcgttcggacgtcggggtttttgcgtttttcgttttttttgatcgcggttgggtagtcgagtcgtaggtagttgggggttttcgaacgtcgtttttgtatcgcgtcgtttttgtttcgggtttcggtagttttcgggttttcgtattgttcgtcgcgttttgtttatagggaagcgtttttttaggcggcggcggttttggtgcggatttttcggtcgtagttatgtgggattcgcgggtagttaggtgcgtagcggcgcgggaagtattggggtatttttggtttttcgggttcgttattttttttggcgggaggcggtcgcgcgcggggattggcgattttgaggtagcggtcgaacgggttcgttcggttatttttgtggggtttatagttatttaggtgtagattcgagttagttgcgcggggtcggtcgcgggggacggtttcggttttttcggttcggagggattagggtacgcgttgcgataggattgcggcggcgcgcggtttgtttagtttttatttcggtatcgaagtcgtagttttcgggtttattttcgtatttttaggggttttcgggggttgtcgataggtttttgattagcgagcgcgttttcggggtaagtatttttggcgggtagaaatttgggagcggagtatagcggtgtaagggaatcgtgttaggcgggaagggcggaatttgcggggaatttggagcgcgttggttttttttcggtagtaggaggtttttttttttgttcgttcgattgagggttgttgggttggtttaaattggattgtacggtttattagtttgggtttatcgagtttagggggaaggtagtagtagggatttaaggttgggaagcggagtttttagaagtttttgtttttgtttcggagcgttttcgaatcggagttcggagtttgttgtttgggaggcgcgttgcgtttttttttaattttttgttttcgtttcgcgg

SEQ ID NO: 11505 - DNA, 510 bp, Artificial Sequence
  Description of Artificial Sequence: Synthetic polynucleotide
cgttttttgtcgggagttattcgttagtttttttttttagttcggttgcgtagcgtttttaatttaatttttggatttattttcgttttagtttttttcgtgtttagcgttttttgtaaatgattttttcggtcgggtgtttcgttttttttttcggtttttttcgcgtggtttgtttttcgttcgtttgcgttcgttcggtttttttgtttttgcgtttttatttgatcgtaaaggcggttagggtagttttcgcgcggtttgatagttacggtttttagtttgtttttggacgtgggaaattcgggtttatagcgtttttacgtatattgcggtatagattggcgttttttacggcgtttttattggaaagcgtttttgtggttttggggagagggcggttttattcgttatttttttcggagttgttttcgtttatttttatgggaggaaatcgtagggcgtgtgagttttcgatttttcgtttttattttttttaggatcggtcgt

SEQ ID NO: 11506 - DNA, 940 bp, Artificial Sequence
  Description of Artificial Sequence: Synthetic polynucleotide
cgggtaattgttcgggttttgtttatttttttcgcgggtcgtatttgttaaggtcgtatcgttagcgttttttgtcgttttttttgtatagagattcgcgtttattttcgtattcgtattcgtattcgtatttgtttttatttcgcgttcgttttgcgtcgaggtcgcgtagtttgcgggtagtggcgggggtacgaggatgcgaatttaggcggggtcgggagttgggcgcgttttttagaattttcgttacggttaggtttgagttttatttatttacgtcgtattttttttttttcgtgggggtttatatggtcgtgtcgggcgcggtttcgcgggcgcggcgatcgggcgataacgcggcggggacggtcgcgggttcggttgtggcgtatcgcgagtcgaggcggggacggttaggcggcgcggggtagtgggcggcgtattttttataggtcgttcgggatgtcgtcgttattttcgttacgtttggatcgcgaggtttcgcgggtggtttagtagtttttggcggcgcgggcgaaggttcgttatttgttcgtcgtcgttgttttcgtgtcgtcgtttgtttttttatagtttcgtcgttcggttttcggcgtcgtcgcggttcggttcgttttagcgggttcgtaggacgttcgcgtatgcgttattttttgtcgcgtaggggttcgcgttgttcgggttcgcgtcgtttcgagttcgcgcgcgaatttacgcgtcgttgttgcgcgttagcggagggaaattcgcgagaagttattggattgttcggtttcggatcggtttttagaatcgttggttcggggtttttagttgtagtaaatttcggagggggcgaagtcggttaggtgggcgattttttttattcggattttttattcgttttcgtttttagtgttttttgtttgcgtttcga

SEQ ID NO: 11507 - DNA, 2718 bp, Artificial Sequence
  Description of Artificial Sequence: Synthetic polynucleotide
cgttcgggtcgttttttttgtttagtttcgagcgcggagttgtttaggatttttagacgggtgcgagttattgtttgaagttttttttttttcgtcggaagaggatgtgtttaaaggatcgtcggaaattttggttgaagatcgtgtagatgatcgggttgagcgagttgttgtagtagtcgatttagaagaagaatttgaagagcgggtcgggtatttggtaggtttcgcggtagatgtcgtataggttgtagttgaagaagaaggggaattagtagagtacgaatacgtttatgattatagttagtataaaggtgaagcgtttttcgcgcgtttgggttattttgcggcggtatacgttgttgcgcgttcggcgtcggcgcgataggaagaattcgacggagcgcgagttggcgcgcgataggcggttatcgggtttcggggatttggaggcggttagcgttttcgatttagtcgttttcggtttcgttttttgttcgttcgtatcgttcgcgttttttttcgcgttcgttcgtcgtcgttcgttttgtcgtaacgcgtttcggcgtcgtcgtttttcggtcgttgcgttgttttcgttcggttttacgtcggcgggcgggggcgcgtagtgttcgttttcgtttgcgtttgtcgtcgcgtttagttcgttttcggtagtcggggacgtatcgtcggggtttacgggggcgcgtttttcgttgagcgtgcgcgtgcgtagtttggttattcggtagatgcgcgcgtagattaggtttatgatgaggtagggcgcgaagaaggagtcgatgtaggaggataggatgtattaggtttcgtcgttgaggtcgtattgcgggtaggcggcgtcgtcgggttggcggtagagcgagattagcggcgggaaggagatgacggtcgagatgagttatacggttacgatggtggttttgacgcggcgtggtgtgcgttttaggttgtattcgacggtttgcgttatcgattagtagcggtttaggttgatggtatatagatgtacgatcgacgaggtgtaaaatagtatatcgagcgttaggtatacgtcgtattatatttgttcgaagtattagtaggttatgagttcgttggttaacgagaagggtatgattagcgtggttattaggatgtcggtcgaggttagcgatattaggaagaggttttgtggcgcgcgtagcgttcggttggttagtacggcgattattattagtacgttgtttattacggtgaagacgatgaggaagtttattacggtagttagttttgttatcgcgttcgtcgagtattggtcgcgcggcggtttttaggaagttttcgaggtattggtaatttcgtcgttgtttttttcgttcgcgtcgttcgtattggggttcgtcgttgtcgttatcgttagcgtcgtcgttagcgtcggggacgttatggttttttcgcgagttacgtcgttttttttggagtcggggcgtagtcgcggtagttcgggcgttttttagtcggggtcggcgttcgtatcgtcgtttgttgttcgggcgcgttcgtcggggatcgcggcgtttagtagtcggttttcggtcgtggtggtttcgcgggcggcgcgtcggagagcgtggttgtcgggtttttcgtagttgtcgagcgtgtaagtgtagagtaggaggcgttcggagcgagcggcgacgcggttgcggggggaggggggtaggtttcggggttttcgcgcggtttcgttttcggttcggtttacggggagcgtttcggcgtcgagtttacggcgacgcggcgttcgagcgggcgtgtttgagcggtttcgcggtttcggagtttagtcggggcgtaggcgataggcggcggcggttcgggcgtttcgttttttattcggtcggttagggttcggcgcgtcggggcgtcggtcgtcgttttttcgggttttcgcgttcgcgcgtttttttcgtttttaattttattttttcgggcggggcgtcggcgtcgtcgcgagtttttcggttgttttcgggcgcgggcgtttttcgcggtttacgtttggtcgtgcggtcgtcgtttcgttcgtcggagttgcgtcgtcgtcgtcgtcgtcgttttgcgttgggcgcgagtgcggtcgtttgcgatcggtttttaatttgggtcgagttgcgtagcggggcgggcgcgcggggcggggcgggtcgcgggttttggggagttggtcgggaatcggagttcgcggtcgtttggtcgaatttgttcgcgcggcgtcggggaggagttcggggcggcggcgcggggcgcgcgttcggcgagggcgttttttttagggtcgtttgtagtttgcgggacggggtcgagcggcggtcggtttgggtggtgagttttagaagttgttttttttaagattggagtttttttcgtttttttcggcgtaggtatgggcgtaggcgggggcgcgtatacgcgcgcgcgtagtacgggcggttcggggtttatggtttgatggtagagtaatttttcgtagtttgggggaggacgcgacgttatttgcgtgcgtataggttttgtcgagtttagggttcggattagattttggatcggcgtttttcgttagagttattttcgtatttatttcggttttagttttttcggtttattttttagcgttgttggagtatgaattataattaacggcgg

SEQ ID NO: 11508 - DNA, 2661 bp, Artificial Sequence
  Description of Artificial Sequence: Synthetic polynucleotide
cgcgggtaaagcgtgtttttcggtgggttataagtagcgttcggtttttttttttttcgttaagttgtttgatttttttttttaggcgcgcgcgtatatattatatttatatattttaaaattaagattcgttttataggatttgggaaaagaaaaagaaaaaaaagtttttaattattatttttttttcgtcgatttttttttatttttcgttttttttttagcgggtagttaaggagagttagaggcgggggaggggagagggaggagaagcgacgtaagtgggtagttttttagcgtcggcgaggcgcgggaggaggagaagtagtggggaggcgtagtcgtttatttgcggggtagggcgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcgggcgtcgcggtagttgtttcggttgtcggtcggcggtttcgcgttcgttcgtttcgttttcgttcgttgttttgttgtacgaatttttttaatttttttttttttttttatttttgagttatttttttgttttttttgttgttgcgcgggtgtttttatagcggagcggagattatagagtcgtcgggatgttttaatttttcggaggaggtggcggcggcgggggggattcggaattttgcgttacggacgagatgattttttttaaggacgagggcgatttttagaaggaaaagattttcgtcgagattagttatttcgaagaggaaggcgatttagttgatattaagttttttttggtgaacgagtttgaaattatttcggttagtaacggatacgaggtgagcgggtcgttgttttagtttcgagaggcgtggcgggtttttgggaaatttagagagggaggaagggaacgaaggcgttcggtcgttcggttgagggtttcgagtagatttttcgtttgttttggggtgtgtgcgtagttgggttttcggttcgtagtgtgtgtgtgtgtgtgtgtgtgtgtgtgtgtgtgtgtgtgtgtaggatgggaggtagaggggtagggtaatttattttaaatggattagtttagggggttcggtggttgaacggttggttcgcgggtaggaatttataatgtttcgttttcggtttttttgttgggttgaggggtgtcgtgttttaaagcgagtagggttgaataacgttattgataaattttttcgtgggacggaaaataaagtgtatacgttattttttggtagatgtttttgtaaaagtgcgttaaattattaaaggtttaggtggagacgagtagagttataggcgggaggaaggggaggcgggcgtgggttggggtaggcggggtcgtttttattatcggtgagtcgggtcgcggggagtaggtcggtcgatggggcgcgtattcgggttgcgggggcggtgcggggtttagtttttgcggttttagcgtttgggttagtagttgggagttgtgggtgcgtcgagtcgatttatcgtaagggtatattttggttgtatcgtttttaattttagttttttttaatcgttattatttggaaataaatttataatttttatttggggtttgggatcggattaggttttaaatttacgtagaagaaaggcggagaagtagcggaagtcgggtattagttttgtagggtggaaggcgttttatcgggttttttggttcgttgcgggcgatagagttggtaatttgagtagagtaaatagagatacgtgggtgttggttagagaaagcgcggagtagggtcgcgt

SEQ ID NO: 11509 - DNA, 801 bp, Artificial Sequence
  Description of Artificial Sequence: Synthetic polynucleotide
cggttattaagcggttttttcgtgagtttcgtttaatgtttgtgcgtttaaattagtagcgttcgaggaacgcgttaattgggagaagtgaattgagggggttcggcggtcgttgaggaggggagcgcgcgggaggaggggcgaggagttcggaggcgggcgcggttggtagtttagagggttcgggcggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcgattttggttttttcgtaagtttttcggattcgggcgttttcggtttttttttatttatttttttgtcgggtaggttcgcgatttttcgtttttcgggtcgtttttcgtcgtattcggttttggtatatttttattatttagttcgggttcgttttcgttttgggtttattttagttttttagcgtcgtttgttgacggagcgcgggagttttaaggggtcggggttattcggtcggcgtgggtggtgttaggttcgggttatatttcggtatcggattcgagttttttagtttttcgagtaggattcggaggaatagaacgttaatttttttcgt

SEQ ID NO: 11510 - DNA, 311 bp, Artificial Sequence
  Description of Artificial Sequence: Synthetic polynucleotide
cggttaacggtattacggaagtattagttggtatagaggttcggtgtaattatcgttttgtatcgtaaaacgggtttaggaagtttttaggagatattagcggtgttagaatcgagaaagtgacgatatagataatttatggatttcgcgtacgggaaacgtttcgttgggcgttaagaacggtgtagtaattgaaaaatcgtttagtgggcgttattggtaaaagcgttgttgtaaaatcgttagtttcgtattagaagtagagtcgttagatagaattcgggatttgaaattatcgaagcggagatcga

SEQ ID NO: 11511 - DNA, 1048 bp, Artificial Sequence
  Description of Artificial Sequence: Synthetic polynucleotide
cgttttcgtaaatttttcgggttttacgttttgcggttattacgtttgatagagaaataattagtattagcggttgattcggttgttcgggttttcgtgtaggcgggcgggagcggataggttttggtacgtatgcgttcggggcgggattgcgttttaggtttgcgcgttgtcgttagattagcgggggggcggggcggcggcggatacgcgttttaggcggtagtcgcgcgagagggattttgtgtttcgttgatttttttcggggcgttttttttcgtgtcgttttttttttttttcgtcgcgtttttgcgaggcgttttttattcggtgggatcgattcggggggatggagggggtacgtttttataatttttttgggatttcgaagagacgttcgcgtgcgatttgagacgtcgttttcgtcgagggtttatgggcgcgtttttataggcgggtagtggacgtgagggcggcgagcggcggggtcgcggcgtttaggagggtcgcgttcgggttcggtttcgcgtaggtcgcgcgcgcgcgttttcgtcgtcgttcgggtcgcgttcgtttcgtttttaggcgtcggtttcggagttcggttcgcgagtagcggcggttgtcggagggacgatgagttgcgcggggcgggcgggttttgttcggttcgtcgcgttcgttttgttgatttgtagtttgtggtcggtacgggtagataacgcgagttaggagtattatacggcgtttattaacgtgacggtgtaggagttcggtcgcggcgtttcgtttacgtttcgtatcgatcgcgggcgttacgggtttgatttttttaaggtcgaggttcgcggttaggtgttggcgtcgttgtttttttacggaggtgagtgtcggttcgggggcggcgggcggtggtcgttgtatttcgcgtaggcggcgggattagggttttcggtttcggttttggttttggttttttcgcgttgttcggtcgatagttttagttagggtcgaggttttcgtcgtggatagttcggtttgttttcgt

SEQ ID NO: 11512 - DNA, 301 bp, Artificial Sequence
  Description of Artificial Sequence: Synthetic polynucleotide
cgggaagtagtaggcgtacggtcgtttggatttttttggaggtgatggtcgagcgtttgttgtaatgcgttaggcgggaagtttcgtcggcgatgcgttcgaagatgtcgttgataaaggaatttatgatttttatggttttagaggagatgtcggtgtcggggtggatttgttttagtattttgtatacgtatacggagtagttttttttgcggttgcgtttgcgttttttgtcgttttttttttgcgttttggttacggtttttttggagttttttttcggggcgggagcggatttcgt

SEQ ID NO: 11513 - DNA, 1395 bp, Artificial Sequence
  Description of Artificial Sequence: Synthetic polynucleotide
cggttttgtgaggtttacgcgggagcgcggaggtttttgggttttagggcgtcggtagatggtttgtagcgtatcgttcggttttcgcgttggttacgttcgttagcgttatttttttttttcgttttttatttttaaaaattcggcggtcgagtagtttcgtatttcggagggttttcggtgtaaaattgagtgggaaagagaaaggggcggagagcgacgagagagggaaggtggggaagaagagttcggtcgttttcggtttttttcggcgagttttgagtttttagggtttattcgtttttttaagtcgaattatagaaattttttattgttatgttaatgacgagaggggttgtggggagagggtttcgaagatttttttggaagaagggaagtttttttttttgttttcgttttttttacgtttattcgagttttttttagttagttttttgcgtttttttttttttatttcgagtttgaagagtcggtggtttagtttcgttttttattacggttttatgcgttttttatagttttacggttttttagtttagttttagaatagaggaggtggtttgggaattcggggcgcggtgttagtcggatttttcgtttttcggttgggcgcgttgcgggttgggtcggcgtatttgcggttattcggcgagttttggtttattgattttcgtttcgagagagtcgggagtttttttttttttttatttttcgttagtttattttttattgaacggtggggagggggcgggagcgggggacgttttttagtttttatttttcggaggtttggcggggcgggtagcggagtcgggcgcgcgtagaacgtagtttttgttttttttcgttttagtattttaaatcggtttttgtagtcgtcgtagtagttgtcgtcgtttaggttgtttgggggggcgattgcgcgttatttagacggcggagcgtcggggatttaaatgttattaaaacggtgatttattattgcggaagtcggtaaatttttgtaggaggtttagttattggttgatatcgttacgtgttttttttttagcgtttttcgttttttcgtttttttttttgcgtattgtatatttatattatttttttttttcggttttatggaggaagtgagaaagttggtatagttacgtcgggtttcgtaggattaggttatttagtgatagatggataatgtaagaatgaatttttttttggaatattttatatttagtagtggcgattcggggatttgtttagttcgagtttatttttcggattataggattataattttttagtcgtgcgcggttagcgttaatagttgcggcggcgacgatcgttttttagtgggtaggggggtgtagatcggttcgt

SEQ ID NO: 11514 - DNA, 766 bp, Artificial Sequence
  Description of Artificial Sequence: Synthetic polynucleotide
cgatttcgttttatgtcggtcgtatcgtgttttttttaggttttattagtatttgggttgttatggtgagattaagatgggtttcgtttataattaacgatgttatttcgtagcgagttaaagttattttttattttgggttcgttacgcgatttttgtcggttttcgttttacgcggttttagtacggcgttaaggtttcgtttataaatcggtttcgttttttcgtgttcgggttcgtcgtttattagacgtcgtttcggcgtagcgagttgagggtacgtttatttttttttcgggtttttagtttttaaggttttagtataatgttttaggaggaagattttaggttttttttttattcgacgttgtttttgggcgagtcgaggtttcgtttattcgtcggttcggttttcgtttttatttgacgttgtttttgtgtagcgagtttaggttcgcgttcgtagtcgtgttattttcggagttcgtttttttgtttaggttttggaagcgttcgcgggtcgttaagttacgttgcgagttttgtttaggaacgtttagtcgttcgtcgaagtttagtattttcgcggcggcgttataggtgaatagtatcgggaagtagtcgtggttttgcgcggagggcgggggttattggagcgtcgcggaggggaaatcgaggtcggagggaaggttaggcgggcgtttggtcgttcgggaggtagatgttagtttaaggatatagacgggttatagcgagggaggttcga

SEQ ID NO: 11515 - DNA, 691 bp, Artificial Sequence
  Description of Artificial Sequence: Synthetic polynucleotide
cggcgattagttttcgtagaggcggggttcgagtttttagttagagttttaataagtagtcgaagaacgcgggtagaggtttcgatatggttaggagagtacgtcgtcgttcgtaggtgttcgggtttcgtcgagatcgggaagaggtggcgtcgttagttttttttagatttaggggtggttcgataggtttaatttcgtttttcgttttgttttttcgttttttttttcggcgacgttcggttcgcggttggtcggttcgtcgcgcgtttcgggacgagggcgggaggcgagcgcgttggtcgtcgcgtatttattattgttaacgtcgtcgtcgcgttttttttattttatttttttttttttaggagaatttttagtttcggtttttttcgtttcggcgtttcgttacgtgatttcgggtcgttttttatacgtgatcgtttttttttttttttttattttcgtattcgttttttttttagttttttgtttcgttttgttggtcgttaggtatttcggggagaggtcgtttggaggcggggttttaggttttatttttcggagggtggagaggggcgggtaaattacgtcgagtgggcggggtttgaatagaggcgggttcgcgggttttttttcgtcgttttttcggttatcggacgagcggtttcgtgttcggtttttttatcgt

SEQ ID NO: 11516 - DNA, 1024 bp, Artificial Sequence
  Description of Artificial Sequence: Synthetic polynucleotide
cgcgtatttattttgggttgtggagtttagttggtcgtcgttcgtttcggttacgcgttgcggttttacgggttcgggagcgagggtttcgttcgcgtcggatatgggtcgtttcgtcgagttcgcgtcgcgtcgttgtcgtttagttcgtcgttcggtagggcgtacggaggaagggttgtgaggtgttgggtgtagggaattgattgtttttggcggaaaaatatataaaattaaaaaaaaaaatgtttttagagaagagtatattatttttgcgggacgttttttttttttttattttttttttttaaattttatttcggggaagttttgatttgaaatttgcgaagaaaattgttatagcgtaagttgatagcggcggggttttaggggttcgaggtggatttagcggggaggggttggaaagagagatcgggtttgggagaatttcggggatggggattaaattttttttttttttcgttcggagattattatttattttcgtattttttcgtagtcgttttaagtttttttttttttttttttttttttttttgtttcggaaagttagcgagttttcggtagcggtcgtattttcgtttcggtggtttgacgacggcggcggtcgtttttgcgcgttttttcgttttttttcggtttagtttagacgtcgtagtggcggtaattgcggtagcggtggcggttttgatttcgcgtatttcgttttttttttttagttagtttattttagtcggtttttttgcgagggggttttttttttttttgtttttttttttttttttttatttttataattttgaaatatttttttttttgttgtttttttttattatattcggatcgggaaggtttcgaatttttggttagcggtttcgatgttgggagcggcgcgattcgggttcggtcgcgcgatttttcgcgttttgcgttgtttgggttaggaggttagagtcggtttgggttggttcgggttttttattcgggcgttgcgttttttcgg

SEQ ID NO: 11517 - DNA, 1339 bp, Artificial Sequence
  Description of Artificial Sequence: Synthetic polynucleotide
cgtcgcgggttttggcgagtaggtgattacggatttttggtgtttgttgggcgagacggtgaagtaatttttttttcgttttttttttcgtttagaaaggtgtaagattcgttaaatcgtgcgttgtatagcggcggtcggagtagacgcgggatggtcgcgcgttttttgtatagtatagaggggtagtcggagagtttgggaaaggtacgagcggggaattagagtatagggtgcggattagaaagagtagacggttagtcgggcggggaaggaagttgtcgagttgtaggtgtggaaggggttgttttaggtttatttttggtagacgagggggcggggagtcgcgtcggggacgaggagattgcggatcgggcgcgttttttgcgtagtcgttcgttcgcgtgtttaagtttttcgggaatggttttcgtttaggggtttagttcgtcgtcgttagtttcgtagagtttgtagttgttggggttcggtagtcgttagggggcgggagttgcgtcgcgaataatggtcgcgtttggtcgcgggttggcgggaggcggagtggaggtagagtcggtgtcgggcgcgcgcgtcggtcgggcgtgttggggcgcgggagcggttgcgtaggcgggggcgcgcggcgcgagcgcgggagggcgcggcgggagcgtcggggaggcgggcggaggcgggcggaggcggggggcggggagttcgaggggtggaagtcggcggcggtcgagcggggttagttttttgtagtgtttgttaatgttggagtcgtttgtaaagtgttttcggtaagaaggtaaatatttttatcgggggcgttcgggagatttcgattttcgcgtcgtcggcgaagaaggtagagggcgttggggagttttgtagtttcgtagtacggggaattcggagaaaagtagtttttttcgcggttttttttttttcgcgtttttttttttatatcgggttttcggggtagtagcggggaggggagatcggcgggggagggaggatagggaggcgaaggaattggggtggggggtgcgtgtgtggtggagggggtgggacgatataggtgttttgaggggaggagtcgggaggaaggcgaggaggtcgggttaagtgggggtgcggaggtcggggagataggaacgcggttgcgggcgcgggaggttggggttttagggggtcggggtggtagcggtcggaagagaggacggcgagtgtagttacggtgtggttgcgagggagagggagcgtttagagtagggtaggggagggcggttcggggagggtttgcgggaaatgggtttgggggcgttggaggcgg

SEQ ID NO: 11518 - DNA, 2273 bp, Artificial Sequence
  Description of Artificial Sequence: Synthetic polynucleotide
cggtttttagggatcgaggggttcgtagagtgatttattttattttcgggaagttgtcgggagtttcgcggattcgtcgcggtttttagtttttatgtgtaggggtttcggggttggggtttggttagtgcgacgtttcgttcgcggttatttatagttgttgaggaatagtagtatcgcgaagtcgagcgtggcggtggttagtaggattaggtaggcgttgtagggtattatgaagtttcgtattagtagggaggcgttaggcggttgtcgggtgtttcgcgttagcggtagcggaggtatggttcggggtttcggttttgcgttttatttttagagcgtgggggttttttacggggtgtttttgggtttttttagggttgttcgttttattttgggatttttggggcggcggatagtagttgtgtttttagagtttatttagttatagttttgggggtgttaggtttcggttttagttttttaggtttatcgtgggaggagggtagaattttttcggagtagaaattttaaatgtgggtttcgaggtaggcggaggagggattgggagttcgtagttatttttgttgtttatagttttttcgggttggtcgttagcgttcggttttttcggagttttcggagtcgcgtaggtcggagaggcggtgcgcgcggtaggtgcgcgggggtcgggcgtcgagggtttgttgttttcgttttcggtagaggcggaagcggcgataggagcgggtaggtaggaggggcggtcgcgtcgggagcgagaagaaagcgtcgtttgcggaggtcgcgtcgggtttcgggttttttttagtttttttcgttttcgcggggttggggaggtgagtgaggggcgaagacgtcgcggagggagggcgggagtagagataaaggaagtcgtttttagggatttcggcgttcgcggggagttttagaggatcgggcggatgcggacgggagagcgtcgtataaaagggaacgtcgggtaggcggggtcgggggtgtttggttggggttggggttggggttgggttcggggtcgggagcgttggggttggggttgggtcgggattggggttggggtggttgaggttggggtcgagggtgggtttgaaggtgttgggattgggggtgggattggggttgggtttgggggcgttgaggttgaagttggggtcgggggtgggattgggggcgttggggttgggtcgggggtgggattgaggttgcgggcgtttaattgggattgagtcgagggtagcggtggggttgggtcgggggagtaggggtcgcgtcgggtagcgtcgcgtgttggagcggaggcgggtgcggtcggggtaggtcgcgggaggaggaagcgtttggggagtaggagttgggtcgggcgggttcgcgtttcgtattcgcgggggtgaatcggagtcgtcgtagggggttcggggggtcgcgtgcgatcgcgtgtgcgcgtcgtcgtgcgtgtgttcgcgagtgtttgcgttcgcggtttcgttttggcggggcgtaggtgggggagggttttaggtgcggcgcgagttggagggtggagtgaggtgagcggtttagaaatcgtttcgtttatttttttttggggattgatagtggtttttttagtcgtcggcgttttcgattttcgcgcggggcggggttatgtaaatgagttttatgtaaattgcggcggggattttttgcgggttcgtggggttggaacgtttttaagaggtcgtttcgggaacgttcgggttttgacgttattgcggttcggggcggggaatgggggtttgggtttatttgggatttttgacgcgtagttcggcgtttttatattcgttttcgtaggtcgtttttttttttggtcgttgtttagtcgggggattcgggggtaagggaggggttcgttcggttcggtgtgtgtattattttttagagtttatgttaggttcgattattttggaggttagaatttttcggcgatcgtattttagcgttttcgtatatttttggttattcgtagtttttggaagggatttttgcgtatttattattttgtttttttttttgtttttgtaatgatcgattttattttttaagttttagttttaggaaagtaaggattcggcgttagggcgtttttgtttcgttagttttttttagtatcgcggattaagttatttgttatattcggttttatttattttgtagacgatagttgtcggtagttattagtgttatcgcgt

SEQ ID NO: 11519 - DNA, 5586 bp, Artificial Sequence
  Description of Artificial Sequence: Synthetic polynucleotide
cgggtttagtttcgtatacggattcgttaggagtaggtggttagtacgcgttgttggcggcgtattacgtaggtgtaggtgtttttattgacggcgttggcgatgatgtttaggtgcgtttcgtttagggttaggtagtcggggtaggagaattttaggggtttttggtttttgtattagttgtaggggggcggggcgttttttgtaggtatagtttttttcgttgtttgtttcgtatttttgttttaaggtcgttcgcgggttgtttatttcgaggatcgttcggggcgtttatttattatatttttttttttttgtggaggattttttggtcgtagcggaaggttacgtttttgttttcgggtattagtttggttttggttttggggggcggtggggtggtggttatcgtggggaaggggaattttgtttcgggtgggggaaagagtttcgttagtgtttttttagtttcgattatggttaaggtttagtttttacgtagttttgtttcggtttcgtgggtattatcgtagtagaagtcgtagttgttggggtagagtttttttatgagtcgtcggcgagcgtcgtagaagttttttcgcgtttaggacgcgtatacgaatagtttgtcgaggtattttgtcgggagcgtggggagtacggtttggtttaggatcgttcggttttcgttttttcgttcgataaagggatttatcgtagagtcggtgtagtttttatagttcgttttgggataacgttttttagtcgcgtagcgtggcgtttaggtgtatgagcgttcggtcgtgttgtgagtgtattaggtttagcgcgtggtcgatttcgtgggtcgttacgtgtattaggttcgtgagttatacgtttgcgggtttcgggggttagcgtttgggagtttcgggtttagtttcgtcgttcgtgggttagtttttcgaggttcggtgtatttgttggagcgtagtcgcggagtcgttttcggtcgtagttacggaaagataagaatgttttgggtttaggcggtgagttcggtttttaggaatgtagttttagttttcgttttagaggcgtagggggatgggaaagggagtttagggttgtcgggatgggggtttttacgggtttttttttttgtttgttagattttagtggtagttattatttcggaaggttttttttgtcgtttgttttaaagttcgatcgcggtagtttattgtgttgtagaggagaggtttttaggaggttagtttggacggttattttttttttagttgtagcgcgtggggtttaggatttagtattcgttgtcgtcgaagtggatgtcgtcgtgcggggggaagaaggcgtgggttagttttttcgtggggtcgtcgaagtagtggtgtagcgcggagattaggtagttcgtgtggttgatcgggtagaagtttggggggagtacggggttgagaggtcgggcgcgtagggtcgggtcggggcgggggcgggcgtttatttattcggaggtcgttgggttgttcgggggttatttcgcggaagttgaagggggatacgtcgttttatatgcggaaggcggtagttagggttcgtcgcgtttttcgcgggtttagtaggtttcgcgggaaggagaggattttgtagggagagtgagtttagcgggcgtcggtcgcgttttttttttcggggtttagttagggcgtatttgtaggtgaggttgaagtggttttagcgtagtttggttggagttagcgtgtagcggcgtttgcggggggttagtgggttcgggattcgggtgggggggatcgtcgagaggtttagcgtagcgacgtttttttttagggaagaaagcgtgcgtgggaggtatcggtgacggtttttaggattaaaaattgtcgcggaaaatggattggaaggaaacgggggtgggggtgtttagggttgggagcgggcgtggcgggttttgtttgtttgtggtttcgggttttttaatttgagcgttttgttgtacgtttttgggaacgcggtttagtggaggggaaggggttgaatagtagggcgaggttttttattttttttaataattggatataggggcgtttaatttttcgatttcgggacgtatattcggatttttaaatatttcgtatatttcgtatacgttttgcgggtttttcgatagattagatttatagacgtgaggatttttttaattcggtatttggtttttttttcgtcgtttatttgcgttgcgttttaggtcggtatcgtcggggtttttagtcgggttagtagtattagcgcggggaggaggtatagggcgattagcgcggttttaagttagcggcgttcgacgtttgttttcggggttttcgaggggatacgggtttcgcggtttatggtagatttgttgtggggtttagggttgtatggggtagtaaggcgcgggggttcgggtcgtagagttttcggggaggattcggaggggaggtagtggttcggcggttcgggttatagttcggtgtggtgggggggagggagacggggcgggagagggggtaaggttgtttttgaagggaattagttggttcgttcgttggtcgagttgtttgttgtttttagtcgggggtatggggattcgcgtttcgtgggttaggggtagaggtttgggtatggtttgttgggcggggttttcggaggggggagcgaagagggttttaggtagttcgggaagggtagcgttagggttttcgtttaggaaagggtagtagtgggggtttttaagtttttattgttgggtagtgagtgatttggtggttttttttttaaatggaatttttaaaaaatttttgagttttatatgagcggagtttttattttggtttaggtagttgagttgggtcgtaggagacgcgtcgttcgtttgatagtgttttcgagagttgggaggggatggtcggatggggacgtggtagtgagtatggggcggtggagggggaggcggggagggggtgcgtgggtaggtaagggtcgcggagggtgttaggttgcggggcggagggagggaatttgttagggtttttcggggagtcgggaaggggcgggttttggttgcgggaagtttcgtggagggtagcgcgtgaggtggagggtgtgtggtttttaaattttcggttaggttttagtaaaggggagagggagacgggagggacgggaaacggagttaagcgtcgggtttggaggtttggatcggttttgattgggggcgggggcggggagttcggagatttaaaggttcgacggggcggtcggcgtttaggcgcgagcggttttgggttgggatcgagatcgggtatcggcgtttcgcggggcgggggtgggggattgggtagaggagtaggagatttcgagttagatcggtttgtgtttgtttcgttttttttcgtttttcgcgtcggcgtcgggtttagggtgacggtagttcggttaacggggttagcgttaagtagttggcggcggtcgcgggcggtttttggaaagcgcgagaggttgggtttggtcgtcgtatttgtttcgatatcgtttttcgtttttttagttcgttatttcgtttgcgtgcgttcggtttttagattttgtttgggacgttttttaattaattttttgttgggacgggattttatagttttggggagtgtcgggttttttggattagagcgcgagttttcgcggtcgtttttaggacggaagagcgaggggggttcgggggtagatataggagttttcgtttcgtcggattcgggtttggggggcgggaggcggtcgtgttcgcgtttgaagggtgttttggttcgaaggtcgtagttcgggcgggagtttggattcgagagtttggggcgggcggggcggatttagggaagggtttttttttttcgtttttaggttcgttcgcgtgtttcgaggggaggattttagaggcgttcggttttttaggtagatagtagaggtaacgttcgagaatttttttttttataaaatatagggcgggggtacgcgaaggtagttcgggcgcggcggacggcgcggtttatacgaagatttggatgcggtcgcggatgggttggcggtagatggggtaggcgttgagcgcggagtcgtagggggcgtatgcgtcgtggtcgtattggaatacgaggcggatgtggttgtcgatgtagatggggtaggtgatgcgtttttttatttgtcggtagcggttttgtagtttttttattagttggcgcggcgggtcgggggcgggggcggcgttcgttattttagagtcgtttgcggggtgggggacgggtgtgagttgggaggtcgggtgggggaatgcggggagtagggagttgcgggggggcgaggttgggggcggggtgttatttgggacgggttgtgatttgtaaggggggttggcggggtgggtgatttggaggtagaggtggggttcgggtgcgggtaggaggtgagtcgtggaaattaggtataaggtggtgtgcgggttggagttagggttgtaggtgggttgtgagttgggtcggggtgtgatgggggggcggtgttttgggtgggttgtgatttggggtggggttatggagggagtgtgatttgggaggggtcgtgaaatttagcggggttggggtgtgatgggggaggagggtgttattttgaggcggggttgtgggtcgggtgtgatttggagtaggtggggttgggggttgggggttggggggtcgggtgtgagttttgggagggcggggtgtaatttggggaagggttatgggcggaagtgtgggagggaaggggtgggggacggggattcgcgggttattagttgagtaggaggcgtgttgggggcgtagagttttatttatttgggcgtagttttttgttgacgattatttggtatttgatgtatttttttattttgcgcgcgtattttgcgaagaggagagcgcggttggttgcggttttattagtcgggtttttttatttcggggttttttatttatttttatatacggtgcggtgttggtacggcgagaatagtattagtagcgttagttcggagtatattaggtatttagcggtttcgggtttcggcgcggcgtttacgtgtaggttcgttacggtgttgggggtttcgagcgtttgtttggggttcggggtcgcgttttcgttcgtttgtcgttttttgtagggggaggaggcggtttgagaggggttcggaggtcgtcggattttattttcgtcgtttacggatttatcggaagcgttgggcgtagttttgaagggttttgagtacgcgattttcggcggttaggtttagcgggtttcgatcgcggtggttggtgtagtttacgtcggcgttttttagcgttaggaagtaggcgatcgtcgcgtttatcgttagtttcgcgttgtcggggaggttcgaggtttgtagttgggcggtaggatagacgtcggtgagggcgggcgtcggggtaggttcgagggaggcgttttttggtatttggtagttttagtagtcggcgt

SEQ ID NO: 11520 - DNA, 1264 bp, Artificial Sequence
  Description of Artificial Sequence: Synthetic polynucleotide
cgcgggtgaatcgagcgttttttcgtttttttggtttgtagttagagatagtttttcgtcgttcgatttcgtattcgttgaggagcgtagggttgtgttcgtatttcgtttcgtatttgtttgtttagggaaatcgggagtttcgcgggtttcgtcgcgggaaggaggcggtattgggttttaaaaattcgtgttgaggagaagtcgagcgttttaatatattcgtcgtcggtcgggtcgggttttcgcgcgtttcgacgtcgttttagtttcgttcgcgcgcgttcgatacgttcgttttcgttttcgttttgatatagatatacgcgcgcgttttcgtattattttagaagtttattcggttcgcgcgcgtatttagatacgcgtggtttatattcgtcgtatacgtttttcgtataaatacgcgcgttttttacgttttcggttattttagatatacggtttcgggttttacgtaggttcgggcgtcgatatattttcgcggtatggatacgcgtgttttttatttatttttcggttaaacgtatttttttttgtagttttttatttttgttttttatatttattttttattttcgttttagaaatacgttttttatatcgggttcgtcggatttttatattttttattcgcgttagaaacgcgcgtattttcgtggtttttttttgtcgcgcgtaaatacgttcggttcgcgtacgttttttcggtttggtttcgtatattcgcgttagaaatacgcgtggtcgcgtattacgttttcggttcgcgagtacgcgtgtttttacgtttcggtttcgttttcgtttcgcgcgcgttttcgttggtcgtcgttttcgatcgtacgcgtttttcgtttagtttcgcgtcgtcgcgtatttattcggatttgttgagttcggtttttgttcgttaggtttgcgtcgagtcgtcgtttattggttttcgcgtttcgttcggtttcgttcggttcggtttagttcggtttcgcgttcgtttagttttattcgtcgtagttggaacgattcgcggggtttcgggtatcgcggttttttcgttattgttcgagtgcgtcgttcggattaatggcggggcgcggcggtgagtttatcggattagatttcgttttttaggtcgcgtggtttaatcggaggatgcgacgttattcggagtcgggtagaggttggtgcggggcgcggagtcgttcggcgcggggattgcgtcggaattgcgttcgagtcgcgt

SEQ ID NO: 11521 - DNA, 716 bp, Artificial Sequence
  Description of Artificial Sequence: Synthetic polynucleotide
cgacgggcgcgtgaggtttagagaggagtagtttcgggattcgtttttttttttgtttgattttggttaggaaaaggggtttggagcgttttcgggtttcggaaacgcgggatttttcgtaggtagtcgagtagggcggtcgtcggggttatcgttgggcgtcgtcggagttttaattcgatttatgtgcgggatttcggttttttgtgcgggagttttcgttttgcgcgtcgggttttcggttttcgttttcgggttgggattcggtttttcgtcggttttattgagttttcgtttcggatttgtcgatttttcgatttcggggagagagattaagagattgggacgtaaagggcgtgaggatcgtattttttattcgtaggtttttttaggggcgtcgcgtcgggggtttcggttggcgatcgagtaggtttcggtcgagtattgtcggcgttgttatttgtgtgtatcggggatagggacggagggacgcgatttttatttattcggttcgtttatttgggtcgttcgcgtttcggcggtttcgattcgacgttcgagttagcggagttcggagtcgttgggtttttcgtttttttcgttcgttcgtttttttcgttttttcggtttttttcgtttcgtcgttttgcgtcgttttattataaaaggtgaggttcggggggagggggcgcgggattttcgtttcgcggaagcgg

SEQ ID NO: 11522 - DNA, 619 bp, Artificial Sequence
  Description of Artificial Sequence: Synthetic polynucleotide
cggtggatcgtttgggcgggtaaacgtttttttacgttggcgggtaggatttgaattcgggtttttagggttttgtaggtcgttattgttttcgttttttttttgttttcggtttttttcgtttggtttgtcgcggttcgtcgttttttttttttttttttttttcgttcgttttttgttttttgtttttttttttcgtttttttttattttttgtttttcgcgatttttttttttttttcgatttttcggcgtcgttttttttttttttttgttttcgtagtttaaatacgcgatatttggagtaatagtagtcgttcggcggtttgggttttattataggtcggtttttatcgcggcgtgtattatattattttattttaaagaattcgtagagaaattcgtttcggtcgataatagaaagtaaaaatatagttgatttttattagggtttttttataggtttcgcgtgaggtaatgaaatatggaagcggtgagatatgtaatgttttattaagcggttttagttataacggcgtgtatgttaattacgtttgtaggttatcgttcgttttcggttgtcggattatttagcgcgttttttttcgagtttcggacgg

SEQ ID NO: 11523 - DNA, 293 bp, Artificial Sequence
  Description of Artificial Sequence: Synthetic polynucleotide
cgttttacggggtaaatttcgaggtttagtttcgcgtgggagtcgtagcggggcgggttcgttttgggttgggcgggtttttttagcgtagcgttgggggttgcgggttttttagtagtcggagtagtattttgagtttcggttgttggagcgttgggatttttggttgtcgttttcgtagtagtagtaattattatttcgttgtcggcggcgtttttttgggaagtagtagtaattggtggagttggagtcgtagtagtttgagtcgtcgtagtagtttttgtcggagtcgt

SEQ ID NO: 11524 - DNA, 2748 bp, Artificial Sequence
  Description of Artificial Sequence: Synthetic polynucleotide
cgaatcggtttttttcggtttcgtattttttagggtcgttcggcgagtttttgtatgttttttattcgttaagttcgttattcggtttcgtttttttatacgcgtattggtacgtttttttttagtttttagcgggcgggtagtttgtcgggtatttaggaagttcgggtttttcggcgtcggaggatttataatttagttatcgtaataagttcgcgtagttaaagtagttcgtttgggtattaggttttatcgtttttgtttcgtggttttaagagggttcgtgttagttttcgaggtatggtcgtttggcgttcggtatattttagatttatttttttttgagggtaggggtttttcggggagagaaagagtagtttcggggttcgtttcgggtttttttgtatagattttttaggtacggagaataatggaatagttttgcgcgttttttttattcgagtaagttttgttttttttttttcgtttgttcggtttttattagttatagggtaaaggtttttcggttaaataggagtttcggcgttaacgtttagagttttcgatacgttttaaaagatttgcgggtgtaggggttggggttagagtcggggttgaggtatcggatatgcgtttagatgcgtatagttggtagttcgttcgttttcggttttagacgttttttttagttagaatttttatatcgcggggaaattcgatttgcgtttttattcgggatttatagaggaagtggagttttagttgtgtttcggggttaattagtttttatatttgtttttttatatttgttttttagattcgggttttcgttggacgttttttttgtaatgcgggatgtttttgttaagcgtaggttatattataacggaggtttttattagttttaggttttgttatattgggattttggttttatttttgagagtttgtaatttttttattttttattttattgtttagttttatttcgggtaggttagagtcgagttcgggttttcgtttgtaatgtttttaagaaggtatatttgagttatgcgtatttggaggtgggttagtttagtatatttgggcgtaatgtttattatagtttgatcgtgaataggagggtttttcgggaaggcgtaaggggagggggtttcgttttttttatattttttttagtagttggttaggagaaagttaggggcggggcggggcggggcggtaggatttatttagtatttggttgaagagtagttgttttaggttttttagtacggttattattagttcggggtttattttgaggaaggcgcgttttttttggtttttggtagaggggataggtttagagtttttttgcgttttggttttgttggagagtagttcgtcgttcgatttgttattttcgtttacggtcgttttaggcgttttgttgagcggtttgattttcgtatagggttttcgagggattcggttcggtttttttaggttgggcgcgagcggagttaggggggttttggcgtcgttcgtcgggttgtttttggtttggaagagcgagtgtttcgatttggatagcgttttggatattagcggagttttacggtttttggattttattttgtttaagtttttgggcgttttggttatatcgtcgttttattcgggtttataaagttgtagttttttttcggagttcgtgagaaaagagaggttggtgagtgatttttgtttgcgtaggttggaggcgggcggttcgtcggggatacggttgtttacgttgtcggatttgaagatttttagtttagtcgcgttggttttggttatgtcgtcgtcgtcgtcgggcgttttggcgcgtttgggtagtatgtttttgtcgttcgtcgttgtcgtttttttgtcggcgtttcgcggttcgttcgcgttttcgtcgtcgtcgtcgttgtttagttttatttcgggttgtacgtttttgacgttgttgtttagtattttgttcgcgaggagcgtatggacgattcgcgcgtttgtaggtacggggggagggggtagggggcgggagcgtaggaggaggaggcgggggaggaggagggggagagagaggacggaagaaatcgaggaagaaggggagagaagggggagagagcgagggaggagggagagaggtaagtcgagggcgtaggggaaagaaacgcgaggaaggaagtcgggaaaaaggaaagagtagggaagtcggggagcgatagggcggggtcggaggaaaaggggcggggcggcggggaaaatataaattaaaatttaaaaattagttaaaggaaggatggaagtttcgcggttttttcggcgtttagcggtgtttttgttttggtgttcggattttagttcgcggtttgtttgtttgttagtttcgtggatatcgtattgtcgggtagcgtttcggtcgtatttagttagttagttagttcgagtcgaggttgtaggttgtagtttcgagtagaggaaggagggaaggggaaggcggggagtaaataggaggaggggagcgagtgtgcgtacggggagggaggtgggggagagatagtgtgtttatttttggttcgggagggggaggtatttgcgagcggagttttaggggcggatgagtggggggtagggggaaataaaggaaaagtagttttttttttagtttttcgcgtagaagcggggcgggtttttggattttcggagggtacggggattttttgtcgt

SEQ ID NO: 11525 - DNA, 433 bp, Artificial Sequence
  Description of Artificial Sequence: Synthetic polynucleotide
cgggattgggcgttagttagtagttcgtaggattaggcggggataggcgggtagtatttataggtaagtcgttagggggtttaggtttttcggaacggcggatagttcgagtttagagtagtcggtagatagtatgatgtcgtttttttggtagtggtagggggtcgggtaggcggtgggtttcgggtcgggttggggggcgtcgtcggtttttcgggaagcgtatagcgcggcgtaaagttatagcgttcggagtttcggcgggttgggtatttcggcggtcgggttattggggtatttggcggtcgggcgcggacgtacggcgcgatggtcgtagttgttttttttcggtttcggcgggttgtatcgtcggtggggatcgttttaggggttttattgggcggcggcggcggcggtgggagcgtcgggacgg

SEQ ID NO: 11526 - DNA, 1376 bp, Artificial Sequence
  Description of Artificial Sequence: Synthetic polynucleotide
cgcgggatttttatttttgcgaggtttttagagtttttttgggaggaggttttcgttggaacgtgtttgggtgaggagagggagatcggtttttaggtagggacggttagggtgcgcgtattttagtttttgggttatttcggcgggagtttgcgttttttttaggcgcgatttttaggaaggtttcgggtggtgatcgtagattggagagtgagttgggttggggaaagagtgaggcggatcgtttttaattttcggtaaagtgtgcgttttcgttttattatttaggggcggcggtttttgatgagtttatgggggcggggcgttaggagtttcgttcgcgagtttttttttcgttttcgcgaagtagtagttcggaattcgcggttagggattcgcgtaggtttttttttagttgaggggcggtcgggtattcgggtttcgattcgcgattatcgtatttattattattatagcgggaattgttcggcggtttttagaagtttcggttcggtcgtagaggtgggttttcgagtatagaggtttcgaaattcggttcgtagtttttagttttaatgtcggggggcgcggtggtttcgggcgattttttatttcgtttttggagtttataggtggttttataatttcgcggttcgcgttgcgttcgcggggtttagtacgttgtcgcgggatttgtttaacgtggagtgtgtgtttgttttttttcgtttcggttttcggcgtagtttttatttagaagacgaaattgaagacgaagagtaggtatttgatgtatttggtgtagttttttatttttatggcggcgcgggcggcgggcggtttgcggggcgcgggtcggttttgggcggcgggcgggtcggcgcggggtttggcgggtggtcggtaagggggtttggcgggtcgaggggcgggggcgcgaagaaaggggcgcgggggcgcgggggcgcgggggcgcgtggggcgttgggcgtcggaggtttggtaggatgcgcggtggggtcgtcgtcgtcgtcgtcgttgcgcgttcgttttttggtcgggcgcgcgtttcgtttcgtagtatttatagggcgtcgcggtttcgtttttttataggtttcgtttcggttagtttacgtttcgttttcggtttcgttttttgtcgttagggcgcgtagtcgaggggtatggggtcgttgtatttatttttaatttggcgcgtttcggttaggattttagggtttaggtgtatcgtgttgggcgcgggaggcgtttttaagttgttgtcgcgtttcgagtttttaagggggtggtagtagggtcgcgtttgaggataggtatgtagcgtttgtttaggagtgtagtttcggtgtcgg

SEQ ID NO: 11527 - DNA, 3393 bp, Artificial Sequence
  Description of Artificial Sequence: Synthetic polynucleotide
cgtagcggaggcgggaggagagtttttggcgggtatttgtttttcgcgtttttcgcgcgtttaaggttgggtttcggggtattttattcgggtcgtttcgggtttagttttagtttagaatgattttatattttttatatttttaagttttagaaattatcgttttgagaattttaaggaggatattttttttcgggttttttgtagcgtcgagtttcggtaggttttttcggcgttcgtttgttgcgagatttttttgtcgtttcgaggagtacgagattttagtcgtttgtagattatttatatttgcggagggtggtagtaggggtttggttggtttgaaacgcgtcggggaggcgcgcgttgtattaaatttcgtttttgtttttaagggtagattcggggtaaggggattaagattttcgacgtatttagcgttatggggatagttatggttaatattttgtttttgcggttaattttaaggttattaaaattttttattcgtagagagcgcgtatagtagtgcggatattcggggattgttttaaggaaggttgagttttgggagcgcgtggatttcgttttatcgttcggcgattggttcgcggggttgggggcggagatcgagttcgcgttgtataaatatttatgagtcggtagcgcggcgcgagcggggttggagtcgggaagttgggttaagggcgttgttttcgtcgaggaggaggcggcggttgggcgcgggtcgcgttatttaggtgttcgtttcgtttttcggtttggatttgtttttgggtgtttagtaggaaggagattgtgtgtatttcgttcgattgcggtcggagcgcggcgttgatttttttaggcggcgggggttcgtttgtttcggcggcggacggacgaaggacggacgtcggagaaagagggcggcggtttgggtcgaggcgggtttttaatttcggcggcggcggcggcggtttggttttgggggcgggtatgagttttcgggggtcgagtggtggtcgttagggttgattcggcgcggtaagcggttcggtttagttattttgattgcgtatcgcggttttagaggaaatttgcggcgttttcgttttttttgttcggcggagttatcgtcgttcggcgcggcggggagaagtggtcgggcgcgcggagaggaggcgagcgagcgcgggacgatgagtcgaggttcggtcgttttgcgtcgcgagggttgagcgcgattcggggttagtagagcggatttacggattgtggcgcgcgtttgtagtcgtttttaaattttcggagcggcggaaaggagtgcggaagggttttgtttaggttgcgggtcgcgtcgttgcggacgcgtttttagaaggggttagattatcggtagatttttttttcgggcgaagtataagggagattttagattattcgttgtattcgtttgcggttttttcgtgggtttttttttcggtatttttttgcgcgtcgtttggagggcgagggtatcgggtcgaggcgtatagtatggagtggggttatttgttggaagtgatttcgttgttggtcgttttggcgttgttgtagcgttttagcggcgttgcggtcgtttcggttaaggagttggtatgttaagagattatcgtgtcgttgtgtaagggtatcggttataattatatttatatgtttaattagtttaattacgatacgtaagacgaggcgggtttggaggtgtattagttttggtcgttggtggagatttagtgttcgttcgattttaagttttttttgtgtagtatgtatacgtttatttgtttagaggattataagaagtcgttgtcgttttgtcgttcggtgtgcgagcgcgttaaggtcggttgcgcgtcgtttatgcgttagtacggtttcgtttggttcgatcgtatgcgttgcgatcggttgttcgagtaaggtaattttgatacgttgtgtatggattataatcgtatcgatttaattatcgtcgcgtttagttcgtcgcgtcgtttgtcgtcgtcgtcgttcggcgagtagtcgttttcgggtagcggttacggtcgttcgtcgggggttaggttttcgtattgcggcggcggtaggggcggtggcggcggggacgcggcggcgtttttagttcgcggcggcggcggtggcgggaaggcgcggttttttggcggcggcgcggttttttgcgagttcgggtgttagtgtcgcgcgtttatggtgagcgtgtttagcgagcgttattcgttttataatcgcgttaagataggttagatcgttaattgcgcgttgttttgttataattttttttttagttaggacgagcgcgtttttatcgttttttggatcggtttgtggtcggtgttttgtttcgtgtttattttcgttatcgtttttattttttttatcgatatggagcgttttaagtattcggagcggtttattatttttttttcggtttgttattttttcgtgtcggtgggttatttagtgcgtttggtggcgggttacgagaaggtggcgtgtagcggtggcgcgtcgggcgcggggggcgttgggggcgcgggcggcgcggcggcgggcgcgggcgcggcgggcgcgggcgcgggcggttcgggcgggcgcggcgagtacgaggagttgggcgcggtggagtagtacgtgcgttacgagattatcggtttcgcgttgtgtatcgtggtttttttgttggtttattttttcggtatggttagttttatttggtgggtgattttgtcgtttatatggtttttggcggtcggtatgaagtggggtaacgaagttatcgtcggttattcgtagtatttttatttggtcgcgtggtttgtgtttagcgttaagtttatcgcggtgttggcgtttagttcggtggacggcgattcggtggcgggtatttgttacgtgggtaattagagtttggataatttgcgcggtttcgtgttggcgtcgttggttatttatttttttatcggtattatgtttttgttggtcggtttcgtgtttttttttcgtattcgttcggttattaagtaataggacggttttattaagacgtataagttggagaagttgatgattcgtttgggtttgtttatcgtgttttatatcgtgttcgtcgcggtggtggtcgtttgttttttttacgagtagtataatcgttcgcgttgggaggttacgtataattgttcgtgtttgcgggatttgtagttcgattaggtacgtaggttcgattacgtcgtttttatgtttaagtattttatgtgtttagtggtgggtattatttcgggcgtgtgggtttggttcggtaagacgttggagttttggcgttttttgtgtattcgt

SEQ ID NO: 11528 - DNA, 1381 bp, Artificial Sequence
  Description of Artificial Sequence: Synthetic polynucleotide
cgttttaacgtgttgttttggtattaggacgcgtatggggaggtggagataaacggtgcgtggggttcgcgtgggcgcgaggaggggtcgttacggtttttttgagagtgcgttgttgagttcggttttggaggcgtgcggcggggaggggttagttttcgggtgttttgtgcggttcggttggggttaaagttcggggcgggtttgtttttgtgtacgtgggagatggttaggggtgttggggatttcgagggttggtgtgaggtttcgggagttatcggggtgattggtcgtcgttcgtagacgggaagttttacgacgtttacgttttttatagcgattgtttcgaggatcgtaagttcgtgaattttattttaaagtcgtagttggagcggcgtcggggttataagttttttttggacgatcgcgattttttgtcgcgcgttggtatttcgggttttatttcgtgtttcgtttattcggagggttcgtttcgtttcgttttatgtttcgttttattcggggttttatttttattatcgagtttcgtttttattttcgtttattcgaggtttcgttttaaaaattcgtttatttcgtaggtttcgttttttttttagagttttgcgttcggtatcgtttttgagttttcggtttcgttttttttcgttttcgtttttgcgtcgtcgacgttcgttttttcgtagagtttttcgtcgattttttggtgaatttgagtcgttgtcgacgttttatcgtggtgttttcggacgtttttttgagtcgggtttggtgtagttatagttttcggtgggtttcgcgcggggttgggtgggttttagcgtagtatttatttttttgacggtttcgtttcgtagggagggtttgtgtcggttgttggagtttattcgtagatttatttttattattttcgagggttagaggcgcgatttcgcgtattcggcgtttcgtttgttgcgttagtatcgttatttggtgattttgttgttttggaggttcggtttcgtggtgcggagtaggcgcgggagggttcggggttagcggcgggttagagatgggcggtgttcgggttttaggttgggattttttcgtggggagttttgcggtattacgttttgtgaatgggttttggggggaggtttcgttgtttggggtttcgatgcggggagtcgtttttgaggttttcggagttacggaatagttgtcgtagggcgtggaattcgtgggtagtcgtaggtgtgtttttgggggttaggacgttaggggttttcgaggtgtttatatttgtaaatcgtttcgatttggtttttagattttttttttcgatttttggaaagaagtgtagttggcgttgtcgcgg

SEQ ID NO: 11529 - DNA, 493 bp, Artificial Sequence
  Description of Artificial Sequence: Synthetic polynucleotide
cgagttgtttttgggcgcgtttggggttgtatttgggttacgtgggcgtcgttgtgtagtcggtatttttcggttaatttcgcggtttggagaaggggttttgtattcgtcgtcgttgtttgttttcgcgcggttttcgtttattgttttgcggttgttttgcgggttgaaaagtttttttcggtgtagaatttcgggtttagcgatagtttgcgtcgagtgtgcgtatttgtcggagattcgttagttcgtcggtcgcggtgagtggtttttggagttattggtttagggcgggttcgcgggatggggcgggcggttcggggcgtagtcggttaggtcgttgttatggtaacgcggtggaaaaacgggtttttgggtatttcgttgtcggtcggttggtaattttttagcggagggatcgggtcgagttcgcggattttttcgagtgttttttggggtttagtcgttggtattttatttttttcgggttcgg

SEQ ID NO: 11530 - DNA, 922 bp, Artificial Sequence
  Description of Artificial Sequence: Synthetic polynucleotide
cgtgttttttttcgttatttggtacggttcgtgttttcgtcgttgatttggtaggttgcgcgcgtatatttcggtcgggtgcgggtcggcggggtatagcggtttttacggttcgttttcgttagttatttttcggttttttttttcgttgttcgcgtgtttcgggtcggtttagtatttttcgagttacgtgttcgcgtttttcggcggggaggagcgtagtcgcgggggcgcgtttcggtgatttcgttttttagttttttttttttgagttcgggagttcggttcgcgcggttaggtgcgaggagattcgggattttacgttcgttcgttttgtttagcgttttagtttcggcgtgcgaggcgtcgtttttttttttgttttgcgcggtgtatggaggggttcgttcggatcgtagtcgtcgttatcgtagtcgtcgtcgcgcgcgcgcggggggatgatttgggggtggtttttcgagtcggttgtagcgtaggaggtttggaggtttagttagtttcgcggagaggtgcgggggtgggggtttcgtcgtagggtcggagggaggggtggcgcgcgggtattgggtttggggggttttggtttaggggacgggaggtttcggggacgggcgggtcggcgttttttggagggcgtgggggtgtagggttgcgtgcggggtttggatgttgatgtttgttcggcggggagtttcggcgtttcgcgttttcgggggttcggaggtatttcgcgggaggaggcggggtgaggtgttagtgatacgacgaaatttttttttgacgatggttttcgggggtaggtgagatgtcgtagagcggggagttagggcgttcgcgcgtttttttaagggagtcgggtttttggttttttttaatttttatttttgtagagcgttcgcga

SEQ ID NO: 11531 - DNA, 719 bp, Artificial Sequence
  Description of Artificial Sequence: Synthetic polynucleotide
cgttcgaggatgttggaggtgggggtcgtcgttttagttcgggcgtagggttgggggattgggggcggaaatttttcgtagaattgtttcgtttgtttattttaagggaacggagaggattcggtttttcgcgaaaatttggtttagggaaagggatttcggaaagtagtttcgtagggttgtggtagttttatttcgattcgcgttgcgtttacgtgtagggttcgatttttttcgggaggcgcggcgtcggttggggttaggcggtcgaggatttcgcggtttttcgtttcgtttcgtttcgtgggttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggattcgggttcgggttgggggcggggaaggggttggatacgtttgcgtatacggcggttcgatttttaggagttttcgggaggggtagaaagggcggggtggaggagggggaagggcgggggtgatgtcgcgcggtcgtaggtttgggatggtgttcgcgttttcgagattcggatagaggtaagtaggggcgtcgtgggtgttagagaggcgg

SEQ ID NO: 11532 - DNA, 958 bp, Artificial Sequence
  Description of Artificial Sequence: Synthetic polynucleotide
cggtgtacggggttatatagtcggaaatttttgtcggtttcgggttattttttttttgaaacggtttttttcggagttattttttggaggattttatttcgttcggtgttcgggtttcgtatttattttttttttttcggttcgtttttcgtacggcgtttattttgtttttcgttttttcgttttatcgtcgttttgtttatattgtttttcgtgggcgttttcggtcgtttttttttttcgggtttcggtttgggggtgtttagttcgttcggcgtcggtttaaggtcgcgcgatttcgtacgttttcgagattcgtttcgtcgttcgtcgttcgggtcgtatttatcgcgttcgtaggatttgggggttttcgttttgttcgcgtttcggtatcgtcgtcgtcgtcgtcgttagcggaaatagggggcggggtttgttcgggaatggcgagtttgcggggcggggcggttcgggggcggagcggggaggggcggggcggagcggggaggggcggggcggagaaggatcgtagggttgagcggggcgttagcgttagtgttcggtattgtttcgggttgggttttttgcgttagaggaaggggagttcggggacggggtacggggttcgcgaggtacgggtgttttttcggggtttcggaagttttttttttcgtttcgtcgttcgtatgttcggatcggtcgttttttcgaggtgttatgatttcgttttttttttgcggcgaacgggttttttttcggggtaggggcggggaggttcgggtttggtagtgcgtttttttgggttttgcgtttatacggtatttaagggtttttttggtttaggtttcggttttttttttcgcgttaggttgtttggtttcgttattttatttttatatttacgaattttttttttggtgtttcgggcggattgtgcgagatgttgatagcgcgg

SEQ ID NO: 11533 - DNA, 3843 bp, Artificial Sequence
  Description of Artificial Sequence: Synthetic polynucleotide
cgcgcgtggttttcggagaggcgtttattatttgcgtggcgttttttcgcgtcggagtgcggttttgtttttagcgttagtgcgtcgcgcggttcgtcggtttcgtaggattggttatcgttttttatttatgtaatttgcgtgtgcgtgtgcgtgtgtgtgtgtgtttttttttcgttcgttttttttttttgtgtgtaagagagcgagggtgggggacggaggtaggtaggcgagtaggtagggaggggaagaagagaagggaagttattaaatatatatatatatatatatatttatatacgcgcgcgtatatattcgttttaattttttagaagtttcgggattgtagttgttttatgtggggtagtagtgttggtagggacgtcggtcgggagcggtcgggagcgggagtcggtcgtgcgcgcgcggttggaggttcgttggggtttcgtttttcgcgggagttattgttggtttcgttggagttgagcgtagagttcggatttgtttttttttgggcgtttcgttacggttcgcggagtagaggagtcgcgtcgtcgagagagagaggagttatcggcgcggcgttttgtttttttgtcgtcgttttcgtcgttttttcggcggtagtagtttgtagttacggtaaggcggcgtgattcgttttacggaaaagcgttttggggatcgcggcgacgtttcgttagttttatcgttttttgtattgttggttcgggtagggttcgggtagtttacgcggttgtcgagggtttcgggagatgtttgtttgtttttttggtttaggaggagggaggttagggcgcgggtggtcgaagaggtaagttgttttggagtttggagtcgtcgtagttttcggagttcgtcgcggattggagtttgggagtaagggttgggggagggtagggaggtgggaagcgggtgggagggaggcggcgcgttttaggttcgtttgtttttttcggatttcgtttttcgtttcggttcggtcgtttgtagtttttttgtagattagttcgttttaggttttcgtcgggcgttggaggagttcgcgaggcggcgtcgggttttagcggttgtagtttgttttgcggggtaagtgtcggttgtagtagtttcgtacgggcggtggttggagtttagattttggagatgcgattttagtttttcgttttttgtaattcgcggggcgttcgtttttttttatcgggcgttcggtcgcggtattgatgttcgtttaggagttaattgaggttgtagtcgttagatggacgtttggagggttttcgggtgtgagtgtgattgtatgattatttttatttttagtttcgggaaatgtgttttgggttgaaatgtgattatcgagttttttagttattttaattgttatttttaaatgcggtcgttatattggaggagtagattggaaggtagtggggcggtgtgtgtgtgtgtgtgtgtgtgtgtgtgtggatatatatacgtaatcgaggaatatataattaattatttgggtgaagggcggggggtttatttagtgagttttttttggcgggggggtcgggcgagttagttgttcgttgttcgttttttttttgtttgttttcgtttaggcgaggttggaaagtattggaaatttagttgcgtggtttttaattttggaaattggtttcgtttttagggtaaaatgttaaggcgatttatgtattcgcgtttatgtggatgagtgtattattgtttagttgggtgtagagtttttaatagtatcgcgttaagtttttattcgatttttaatttttttttattttttaatcgtggagagagggtttatagaaatgtagttatttgtaaattatcgacgtagtgaaaggggcgtagggaggtagttagagttttgtttgaatttgtatattggtttggtgtttgtagtatacgagattatttcgttgttttgtagaaggcggtggtggggtaagttcgggattttaatcgtcggggtggggggtggggggaagagggtgtttatgtattgagttttgaggtcgagtaaggagagagatttgttgagcggtatcgcgggtaattatataagttgtttcggtgattattcggaattgtgatgcgagttttcggttttcgaaagataagtttgaaagtttgtttgtttggggagtgtaagtatcggggcgtttttatttcggtttgggtagttaggatacgtttcgtattacggcgtttatttgtgcgatgggcgtcgggtgttgatgttgttgtttttaaagaatcggttatcgaggtagggattaagtgggggtattcggaattgatcgtagaggaggagttagttagaattgaggttttattgggtttttagagttttaagttttttttcggaggtgttggaaggttttttagggaacgtcgtttttagaaattgatttggtgttttggggagttttaaagtttttttttttcgttttttttgggcgtttttttttgttttttaagttttgtgttttttacgtgtttagaaatttgttcgcggtgtttggttttttttggagatgtttaggtagtttagttatttaggtttacgttggcgaggggttagagggagtagaacgttggttttgtcgggttgttatttttatttatatttatttttggttttttgcgttagttcggcgttgatggggacgggatggggttggggtcgggtatggttttcgttttttcgtttttcgtttttgtagatagtagtttgtttttgttgcgtttatttttttcgtttcgtcgtttttttttagcgtcgtagtttgtgtattacgttgatgggttttgatagagaaattatagtaagagtatgtttttaaattttgattttcgtttgtagggggataagttattttagttttgatatagtcgtggggaacgttgaagtttgggatatattggttttgaatttttttttttttagttcgtagttaggagatggtgatgtgtatgggtggggagtgttttgtttttgttatattttagcgttttgaaatttttcgtttttttttattgaaattttcgatttgtttgaatttgttttttgttgtaaaataaattttttttttcgtagatttgtggggtttttcggattttttgtcgttgttatgatttttaataatgcgattgaaaagttagtgttcggttggaaaaaaatttttaggtgttagtcggtcgcgttttgattttgttgaaggagtttttaattcggttgttagaggggttttggtttagtcgtgggaatttaggaagaaggagggcgtttcggaggcggttgggttagtttttcgggtagggcgggaattaggtcgcggcggggatcgtagagggggaggggacgggatttcgcggtaatttgtttttcggcgagtcgggttcgcgtattttagttttttcgttttagtttttcgtggttcgtttttttcgtcggtttttagttgttttcgtggtataggagtcggtcgcgattttttcgcgtttttcgtcggagttcgcgggacgtcgttaattttgggtttttcggtggtcggagtagcggtgcgaattagcggggcggtcgggtgggcggggtttgggcgggaaattggagtcgagaagatcgcgttttaggttaagttttagtcgtaagcgtcgcgcggtatagtgtagggtttcggtcgcgtttttttttcgttttcggttcggtcgcgtttttgcggatttatagcgcgtttcgggcgttttgtagttgggtttttagcgggggagtttttttcgttaaagttacga

SEQ ID NO: 11534 - DNA, 384 bp, Artificial Sequence
  Description of Artificial Sequence: Synthetic polynucleotide
cggttggtcgggggacgtgttcgcgttgtttttttttcggtcgttagggggcgtaggaagaagttttggaggtttgtttcgggatcgcgtattcgtttttttttttcgttagttttttttttattttcgttgagtttcgtttcgtcgtttgttttttgcggtattcgttcgtatacgaatttagttcgggaatcgagttgcgggagtgcggtttgtgtcgtttcggttaggagtttgtcgattgtagacgttttgcgaatcggtaagatgtgttttttggggttgtttttttttttatcgtttcggggttaagttattttatatgagtataataacgagttggtgacgggtagtagttatgagagttcgtttttcgattttcgg

SEQ ID NO: 11535 - DNA, 1432 bp, Artificial Sequence
  Description of Artificial Sequence: Synthetic polynucleotide
cggacgttagggggtgtttttagttttagcgtagaatttcgtttcgtataatttatcggattagttaggtcgtcgaagggtattaggttttagttattacgacgtttcgttcgacgggtcgtagttatgtaggagtggtagaggttgtttgacgaagttttttttgggggtcgatgttttttttcgggtgggaaggggcgttgtcggtgagggttattttggcgtcggtttgcgtcgttcgaagtcgggggggaggggaggttttcgtttagtaggggttacgttcgtttcggacgggggtcgcgcgggcgtttaggcgacgtattttcgtcggggttcgtgatcgttacgttcggcgggcggcgttgcgttttttttcggggtttcgtttaaggttgtagttcggttcgcgtcgtttttagggcgtttttttcgttcgcgttgggagttcggcggtcgcggtttttttcgttagttttagttgtagtttgtttttgttgttttttttcgttcgttcgttcgttcgcggtttgtagttttcgggttcgtttcgaggtggagggattgtttttttcgggggttgtacgtattcgtagcggtttcggtttttcgtcggatatatatcggtttttgtaggttgtaaagaatagcggcgagaatgtatcggttttttttttttttgttttgagtttcgggtgtggggggaggggaagtcggcgaatagcggcggcggtagcggcggcggcggcggtagcgggcgacgtaagttcggatgtagtttcgggggtttcggcgttgagaaatagtcgattttagtggcgtaggacggatacgaggacggttcgggggattgtgtatcgggtgtgcgagttcgtaagtcgtagtaggggtcgcgcgcgttgggtttttacgcgtttatggtttcgggcggcgcgcgggggttttcggggtcgtagtttcgcgtcgtttggcgcgcgtcggcgtttcgtttggttttaggttcgggtgtcgcgcgtcgcgttttataggcgtcgggttcggttgttcgtttttttcggtcggcgcgcgtagttttttcgcggagtagtcggttaggtagttttgttcgttgtttcgttttggttcgattgataggcgcgagcgtcggtagtagttttcgcgtttcgtttttcgttcgtttttcgcggtttagtttaattagcggcggttgagaggcggttattagggtgacgcggtatcgcgttttgcgaggggcggagtcgggggtcgttacgcgcgtttttcgcggtaaaatttaaaggtcggtagggcggttttttaatttttttttttaagtagggacgaggcggaatttgtttcgcgaggattgtaattttcggtatgttgcgcgtcggcgtcgggtggaggggtttcgattgggggcgtagggcgt

SEQ ID NO: 11536 - DNA, 325 bp, Artificial Sequence
  Description of Artificial Sequence: Synthetic polynucleotide
cgttgtcgtcgttgttttttcggtttttttgttattattttttacgttttgtagttttgttttttgtttacgggttgttaagtcgcggtttggtcggtggtggtagtggcggagttagataaagttttcgtttttttcgttttagagttttttaggcgttttaagtggcgggaaggtcgttagttttttaggtttcgcgttttttgtttggcgtgggggtggggagtcgcgtttggttttaggagttttttggtttttgttaatttttcgtttttgtatattgcgtttattgtttgagatgcgtcgagacggttttcgttgacgt

SEQ ID NO: 11537 - DNA, 1242 bp, Artificial Sequence
  Description of Artificial Sequence: Synthetic polynucleotide
cgtttatagataacgttttttcgtcgttggcgttggttcgggatgcggtttcgagatttttgtagtcgcgcgttggtttaggggattttcgtaggacgcgggcgggcgtcggggtcgggtcgggtttgggtagagtgataggtttttagtcgtgagttttataagtagatttatttataatatttcggataggagtttaggtcgcgtcgttcgcgtcgttcgcggggattcggcgtgaatttatacgttttttttttatcgtttcgtcgtttgttacggtttcgagattcggttagttttttcgggggtttttttcgtcgcgtagtatttcgttcgtgagtagttttcgtttgcgtttttttttttttagggcggtcgtttttattttcggtttttatttagcggggatttattagggcgagggttgaagatttcgcgggacgtcgcgcgtcggggatagcgacgtatttatttttttagttatttgggaggttgtaggttcgggtcggagttcgaggtttaggggcgcgcggagtagttttggttaaggcgtagggcgcggggttgtatgggggtttagtttagcgtgtatatcgtgtattttttagcgtagggtttcgcgttttttcgtagttcggtaacggtcgttattttagagtttcgtttattaggagtttcgtttagggtatcgtttattcgggtttcgtttttatcgcggttttcgtcgtggtttcgttttcgtttagagtttcgtttttagcgtatattgcgttagtcggatttgttttgtagttgggttttttggaggtttttatttcgcggttattgaagcggatgagtgtgaggttgattgggggtttggggatgggggatcggagattattaagaatatggttgtgttgggaaatttttttttagagtagagagggagggttttttttcgtcggggtgttttttattttttagtttttttcgcgtgggttcgtattttagttagaggggatacggcggttaggtttgcgttgttgcgtttgagtttaggtcggtagaggtcgtagatttcggttttttagtcggtagggattcgtaggtgcgcgtttttacggacgtttttcggggaagttcgagttcgttttttgtaggtcgggaagtattcgtttcgagacggtcgtattttcgtagcggaagggcgtttgtattatagttgtagtattagcgcgtgcgaggcggggttagggtcgg

SEQ ID NO: 11538 - DNA, 1460 bp, Artificial Sequence
  Description of Artificial Sequence: Synthetic polynucleotide
cgcgtttttgttttttttcgatttagtcgtaaatttcgagttttagcggtcgttttttttttttttcgttttttttgatttaaggttttaaaagataaacgtgttatttttcgtttcgtttttggattttggtttcgatcgaatgtagtggggatcgagaagcgtaaggtttaggatttgttagaggggcgcgttaagggcgtttttgtttcgttaggatattatcgtttgggtattttattttattttttcgtagttttttttggggtcgggcggggcggggcggggtaggggggtcgggcgcggtttacgcgttttttcgagtgcgcggtgcgggacgggcgcggttgacgcgttttcgtcggtgtttgtgttttttcgtaggttaggagggtattttgcgttgttattcggatttggcgggtagcgagttgtagcggggtacgtttacggtcgagtcgtagcgggaatagagcggcgtaggtttgaggagtttgggcgcggacgagcggttgcggttggtcgagtttaacgcgtagtatcgcgcgcgtttcggtttttttttcgtgttcgtcgcgcgttttagcgatcggacggcggtgtcgcgcgagttggcgcgtcggttgttttgttcgttcgcgtaggagttgcgtattgttttgggcgaggtgaagaagatcggtagtttgcgtttggtcgatttttttcgcgtagatttcgttaagttgtagttgtcgcgcgggttagggattcgggacgtataatcggacgcgcgggggttacggttcggagttgtgcgttttgggcgggaggcggattcgggtttggaatagcgtttatatacgtgtataaaggaagtggagaattgaggtaattatacgagtaatgagtttttttgttcgtttatttatacgcgtacgcgttgttaaaatatttatattgtttagtgttttgtttcggatttatttagtttattgttttaattttttattttttttgcggttttcgatattatcggtttttgtggattttaaagcgtttatttagttttttttaatttttttttgttaagttcgaattgtaaagtaaaacggacggaaaaggaattttttatgttatagcggtttgtttgtttttttttttttttattttatttgttgcgttcgatttttatatgtgagcggaagcggtgttttcgtttttgggtattaggggagtagattgggagttaggaaagttaaacgttggtttcggttcggtttggggagtcggggaagtcgtaggaaggaggcggtgggtcgggaagagttttgcgaagggaagagttaatcgaagggttgggaaggcgtttcgtggggacggacggaatagttgtagttatcgtttttaaaaggcgggaggcgtttagttaaagatttttttcggaggtcggttttgggggggtggttcgattgtttcgg

SEQ ID NO: 11539 - DNA, 1064 bp, Artificial Sequence
  Description of Artificial Sequence: Synthetic polynucleotide
cgattggcggttgtgtggcgatagcgtacgtttagtttttggaaagttttgtagtttattaggagagttttcggggcgtttttttttttggtttttttagggatttgcgggtagtggaggagttttttatagcgaggtagcgcgtttaagtcggataggatgtttacgcggtatttttttgtttcgggttggaaggcgaattttaggtttcgcgcgtttagggtattgttggtttttagtagtttttttacgattagaggtaagtttcgagttataatttttagttgggtgaagattatttttatttttagtattagtggtagtattattgttttttcgggcgcgttatagcgtagttgtagtcggacgcggtttcgagacgggttgcgcgcgtttaggtgagagtagcgtatttcgttagggttaaagtcgtacgggaagcgtttgggatttaggcggttcggtcgttgggttagtgcgtcgttgtttagtatcgaaatcgcgtagcggttttcgggttgtatttgtaatattaggttatgtaggggatttagttagattttacggtcgaaaggtattcggagttcgcggttcgttagtattatggtttttttagtagggatttttgtagttttcgcgagattaggggatagtaacgttttgtcgaaggtagcgggttgtgtcgggacgcggtttattagtgataggagaagtagtagtagtagtagtagtcggggcggcggtggcggttttggttgaaagttggtggagttgtttgttcggcgcgaggataattcgggagtttcggttgagtgtatggtttcggtgttcgggtttggataggttagtttgagagtatgcgaagtcggttttcgggtagataataagagatatcgtcgggaagtgttaggaatttcgcgcgttgttcgcggggtttttttgtagtcggggttgggttagaaggatggtaaagttgcgcggcgtcgttcgggttggagtcgtagtcgaggagtcgaagtttttttaggtcgtttagtttcgtcgttagcgttttaatcgcgcgg

SEQ ID NO: 11540 - DNA, 622 bp, Artificial Sequence
  Description of Artificial Sequence: Synthetic polynucleotide
cggtttgttacgcgttttcgtcggggtttattcgtatttgggtcggggttggtgtttacgcgcgacggttcgggagtacggatttttgtttttcgtagtatcgtttttcgggtggagtcggcggtttcgtttcgtagagttggggttgtatttggggtaacggggtcgggtttggacgttaggtcggaggagtagtatttgttaggagtacgtttcgtcggtaggtcgtaggagttttgggagtcgtcgttatgggtacgttcggcgggtggggggtcggtcgggttaaagattcggagttacgcggggcgggggtcggtatcgagggtcgggaggcgcgaagggtacgcggcggcgggaagcggggcgattcgaaggtttacgggggtcgggaggttgcggggcgttcgggattttttttcgggtggttatcgtgcggtcggggcgcggaagttagaggtgtttagaggcgtcgatttcgtcgaggttgcgattttggttcgttcgttcgtggggtattgtaattttcgtatttttattttgcgggtcgggagtgcgtttggagcgggacgggatttagcgggtgacggtaggggcggtagaaatatcgtttaattggcgg

SEQ ID NO: 11541 - DNA, 1622 bp, Artificial Sequence
  Description of Artificial Sequence: Synthetic polynucleotide
cggttttatcgggttgtaagggtcgggaagttgtgtcgggggcgttttagaggttagagttagggagggggttcgcgatataggcgggttttttaggcgggtttagggttaggatagcgcggtattattcggttagttttttgtagttaggatgaaggtcggggatagacgtttagttttagattttttagatagggttgggtagtgtcggtgggtgtttgggagaggcggaggcgggcgtatttttagtattaggttcgggaaggatacggtgtttagtcgttggagtttttggtttgcgtgttttattttgattttttggtatttggtgaacggttttttcgtagggtgggggtagttaggggatttgtcgaggaaagttggggatagcgggtttggtggcgcggttcggcgcggcgcgtgtttggggcgcgtggtcggttatagaattcggggagggtggaggttttcgggtacgcgtcggggtggtgggtagttcgggacggtagcggcgattcgttatttgaggaggggcggggattttatcgcggttaggtcgaggcgtcgagggttttttgcggttttcgttttttttcgttggtttcgacgtcgcgttcgggtcgggattcgagtttcggtttcgcggggtaggtttaggtttgcgcgttgcgtttgtagtcgaggtagaaattcgtttcgaggcgcgggcgtcgggttcgggttttaaggatgcgcgtcgggttttttttcgcggggatagtcgagtttcgtcggcgttttaggtgttttcgtagtgcgttcgggcgcggacgtttttttgttttcggaggggaagcgggagggtttttggggtaacgtttcgatttcgggttttttaatttgggtcgatagtcggttggtatagggaggtttgcgcgggagaggggcggagagagcgtagcgcggggtatagcgggcggttttcgtgtcgcgcgcgcgattggaaacggcgtgtagattttaaaacgagggttttatagagggttacgaggggtaggagagagttttcggagaattttagtttttcgatacggttattttttggtaaacgagcgagaattggggcgtagagttttgggagggtcgttttttcggcgggagcggttcgagtatagttttatagtagatgcgagcgcggcgggcgttttggtgacgaagtagcgggatttgtaggaggtagaggtttggtggggtcgtggacgttacgtcgagttgtttagatttttttagaagatagtggggattatttaacggtttttagtagaaattaagttaggtgttcgttttacggagattgttcggttgtagggtggaggttggatgagaataggcgtttttttaggtaggcgttcgtggtggtaacgttgtttaggaggagggtacgggtttcgggaagatttgcgaggttaaatcggtagtttcggagaattgagcgtaagaggtcggtgatatagagaggagttcgggaggtcgtatgttttaggttgaagttatttggcggggacgtttattgagatgcgaaatataggaagggatagaggttgcgtagagggaaaaggcgatggattcggttttggaaacgt

SEQ ID NO: 11542 - DNA, 324 bp, Artificial Sequence
  Description of Artificial Sequence: Synthetic polynucleotide
cgatttttcgagggaggagatagcgtcgtttttttatttgtataggtgttttcgtcgtaggtttcgtatatttatttatggtatttatataggggttcgaagaatatgttcggtttagttacgtggtagatgtagacgtcgtagtcgtagcggtttcggtcgtggtatagcgcggttttcgggggttgtttaggtgcgcggtagcgtcgtttcgattcggttcgggatagtttgtaggcggcgttcggttagtttttgcgcgggcgataagtaatcggtaggtcgggttagacgcggacgtcgttttttgtttcgaatttacgt

SEQ ID NO: 11543 - DNA, 1881 bp, Artificial Sequence
  Description of Artificial Sequence: Synthetic polynucleotide
cgtattcggtttcgaagaaggcgtttttcggataaaatcgaggaatttgttttgttttgtaaggaattagggtttgttgatttttagattttaacgagaatttttgtttttcgtaggcgttttataaatttttattggataattttatcgcgcgttattgggttttcgggagattcgtgatttttattcgttttgggcgcgggttcgtagagttttaattcgcgttttcggtagtcgggatttttcgttcggatcggtttttaggttggaaatattatggttcgtattcggggcgtagtcgagatttatcgcgtcggaggtttcgggattcgtttagatcgttgtttggttattttacgtttttgagttttttatatagttagtttcgtgattttcgagtttcgtgattttcgagtttcgtgatttttaagtttcggaagtcgttgtaggtagcggtttagttaggtttcgttttttttatcggagttttacgcgttaattttagttaggtttcgttttcggtcgttttaggcgtggatttaagttaggtttcgttttttgtttggttattttaggcgtttatcgttttaggcgttttttagtttaagtttaatgttcggttgttttagacgtcgatagttttatgtttcgttttttaatcggttgttgttggcgttttttggtttaggtttcgttttttattcggttgttttaggtattttttaggttagatttcgttatttatcggtcgttttaggcgttcgtagttttaagtttcgtttttcgttcggttgttttaggcggttttcggtttaagtttcgttttttgttcggcggttttagaggttcgcggttttaggtttcgatttttgttcggttgtataaggcgttttttgggttaggtttcgtttttagttcggtcgttttaggtttcgtttcgttttttttgtgcgcgtttcgttcggtagtttgtgggacgcgatcgcggcgttagtttcgtttttttgtgttgcggcggcggtttttcgagtttttttcgacgcgttttttaggttagcgagtttcgcgtttttcggtgacggattatgtcggcggcgggagcgggcgcgggcgtagaggcgggtttttttagcgaggagttgttttcgtttcgtttttcgttgtatcgcgtttgtcgcgacggggatttggttacgttttgttcgttgttgtagtagatattttacgtttatttggtttttgaggattttttttatggttggacgttcgtgtattgggtcgcgtatttcggtaaggtgggtgcgaacgttttaaggcgttatttttttcggttgtttagtgggagtcggggaaagcgggtttgaggtgcgggggacgtggggcgtgtcgggatcgcggggcggaagcgggatcgacggcgtttgtgtttcgaggggtttagggcgtttgtgcggtagcgttcgcggttcggagtcgcggcggggtagtcggggggcgcggggcggaagcgaggtcggtggcgtttgcgttcggaggggtttagggcgtatgtgcggcggcgcgcgtagtaagtttttaataaggcgggttttaagggtttcggcgtttgttggtcggattttgtgcgagcgcgcgcgcgcgcggatggtgcggggttttttaggtcgggtcggaggcgcgagcgatttcgtagagtcgggtattaggtcgcgaagtcgtttaggcggttttcggggagtcgagttggggttagaggcgcgcggggaatgttcgggcgcggtcgattttttggtttcgtatagtttcgttagtagtcgagggtcgcgttgcggacgagtttagtcgaggagtaagcgtttcggcgggattggaaggtttcgg

SEQ ID NO: 11544 - DNA, 944 bp, Artificial Sequence
  Description of Artificial Sequence: Synthetic polynucleotide
cgtttatagggcgtcgcggcggcgttgtagagtttatagtagttcgtgtcgtcgtttcgttcgttagcgttttagcgaggaagtagcgcgtagttcgcggtttagcgtattcgtagtagcgttcgtagttcgttcgcgttatgttttaggcggtcgagcgtttttaggagtgggttatggagggttttcgcgacgggttgaagaaggagcggttattggacgatcgttacgatagcggtttggattttatgaaagacgaggagtacgagtagatggttaaggagttgtaggagattcgtttcgagtcgtaggaggtgtcgcgcggttcggagttttggaagtagtagtttatcgaggacggggattcgtaagtggcggaggttcggggttgggggtcgtcgggagggcgggacgcgcgcggtttgggggtgggaggcgtcgggtttggagttcgagtcgggggattagcgatgtagtcgggcgggcgtcgcggtatttcggggtttttgtatcgtttcgaacgttgtagggttgtagggtcgcgcggggtatcggtttaattcggaggggcggcggttgggttttggtggatggtagcgtcgttatacgttttttttttttagattcgttttttaggtcgggggcggggcggtagcggggacgcgaagttttcggttgtataaggcggggcgggagtttttggtcgttggcgggcgtcgagtagtcgggaggggaagtatagggcgtttcgagttggcgggagggcggggcggtttggtcggcgttcgtcggggtcgcggggggaggggggcggaaagtttttgggcgtttgttaggaatatttagtttataataatttcgcggaaaatatcgcggtttcggtttttagaaatttcggttttgcgtaatttttcgtagttcgcgtttttttgggttttacgcgg

SEQ ID NO: 11545 - DNA, 1514 bp, Artificial Sequence
  Description of Artificial Sequence: Synthetic polynucleotide
cggagtcgaattcggtgtttttgttcgtttggggtttcgttagcgcgtcgtaagtttttttagaaatttaaattttgtaggtcgtatttttaattcgtattttatttaggttttcgtttggcgtcgatttgttttagtttaattttcggtttcgtagattaggtatttttcgggacgcggggtagattttgcgttcgggttttttttcgtagtcgggttgttcggtttttgcgcgcgtataataggcggtacggcgtagttttcgggagcgcgggattcgggtgttagtttcggcgtttagttatagcgatatagatttgggtgtcggggttcgttagggagttttgtgattcggggattttcgcgatgtagagaattagggatcgcgtacggagtttaggcgcgtagtttgtagttaggattagtttttcgttttcgtcgttgaagtcgtttcgagttttacgtttttttcgttgtcgggttcggttgttttagggtttcgttcgttcgttttagagtgagcgattttcgatttacggagaagcgattttattatcggtgttcgatatttagagttaagggagcgagaagaaggcgaagaaagaggcggagagcggtgtattgttttcgttgggattcgcgatttttagaaattttttcgaaatttagtttcgtcgtcgtttcgtcggtagggggtatagcgggcgttcggggcgcggcggttgagcgatggggcgagcggaaagggtttagacgtttggtttttgtttatatttcggagaaagttttgagtattaggcgttgggttttttggttatttttttgattttttttatcggcgtcgagtttgttttattttttttagttttttggtttcgttagttagaggggcgtttcgcgttcgtttcgttttttatttacgtttttcgattcgattcgttttttcgaattttcgttttttgagatttcgttttcgattcgttttaattggtcgcggcggtagtcgagtcgcgggagttgcgcgttgagttcgcggtagtacggggagcgttcgttcgtttcgttttggatttaattaagcgtttcgcggaggggtgcggttatttgggggtaggagaaagcggagtacgttatttttttagggatttaggaagcgaggcgagttttaggtggacgcggtggtgtggattacggcgattagggtttttttttttgttgtggagacggaggtgcgaggggacgtcggcggttttttattttttggtcgagtggtttttttcgttttcggttggattttttcggggcgttttttttagagtcgagtcgggttggtcgggggcggttgtttggtttgagtgtcgttttattaaagcggaacgtcggaggggaggttatttcgagagaaggcggttttcggcggaggtggtttcgtgaattttgtagttttttgttcgttcgttattcgagacgtcgcgtttcgtgggttttacgttggatggagggggcgtcgtcga

SEQ ID NO: 11546 - DNA, 2144 bp, Artificial Sequence
  Description of Artificial Sequence: Synthetic polynucleotide
cgcgtttggatgcgtttttcggattcggttttatataagttttagtttttcggattttgtatttttttcgcggatttttttatttttttatttttaggtttagatttttttttgtcggaatcgttacgtttttttatttttttattttcgttttattcggtttttttttttttggtttttattcggttaggttgtttcgttttggtagttttcgagggtcgttcgaggttttcgtttattaatcgttttcgtttggaagaatgcgttcgttcgagcgtattttcggcgggtgttaaagtttttcgttttaataggtgtttttgtttggttacgtatagttttgttatttggggttcggacggagacggcgataggatcgttttttgtagggcggttgcggtttcgtacgttttcgttcgggtttttagagcgttaagggttttcgtagtttcgtcgtcgttttcgttgtgttatattgtttttgtttttttgttcgtttagatgtcgcgaggttgattttatgtaagggtatcgttaagttcgggcgttgatattgtttatttattcgtggtggcggattttaaggttgggagtgagagacgcgtatagtgcgagatttttttttaatttagagaatttcggggaagttgggtgttcgcgtcgaagaagcgggtttaagttgattcggtttagaagggggttcgaagttaggcgtagcgtttagagagtttttttttatttacgtttttattcgatgttttttgtttttagaaggttggagaggggttgcgtattgttatttacgcgttcggttgcgagtggtttttatcgttcgttcgtcgcgcgttgggttcggtagtttttcggggtatacgaggttttcgtagtttttagattttcggtttcggtagcgtagagtcgggagagtcgttacgtttttagtcgcgcgcgtacgtcgggtttattaaatttgtagtatttttttttagtttttattttttgttatttttttttagtcggtgcgttttagtttcgtcgttcggtagaggttgttataataacgggtaggaatgttttaatatatataaagtcggttcggcgtagcgggtatttagttttggtcgggtttcgcgttttcggtcgtcgcgtagggtttggacgcgcgtcgcggttttttagtcggtcggtcgacgttcggggcgtatttataatgagcgggatggtgcggttttcgcggagttgtttcgattttttgtttgttttttgcgcgtttcggtcgtcggaggatgttgcgtgggttcggttgttttgttataagtagtagaaagtgtttaggatttaggttacggttaggatggcgatggtattggcgcggattttttttatggtgggtagacgggcgttttaggtgggggattgggtcggcgtgttttcggggtcggggcgggggcgttcgtagttttagttgtttgttttcgttcgcgtttagttgtttagttttgtagagtagaaaaaggagagaggtgggggggcgggggggtgatagggagagataggatcgcggagcgatttttacggttttaatgttttttagtttcgagcgcgcgcgtttttcgggcgtttatttattcgtgcgtagggtcggtttcgcgttttagtcgtcgtcggttgatttattaggttattgcgtattgggagagaagcgcgtcgagtgggaagcggcgcgggtttttttttcgcgttcgggaattcggcgagatagacgttcgcggcggaatggcgattggttaaagttagtttcggtttttatcgttaggtgatcgaacgttcggtagttgttttcgcgcggttttggtcggttttgtcgatttatatttattttcggatcgagcggttttgagttatcgattggagacgcgcgattttcgatttgggttcgcgtcgcgagttgtagtttcgggttgcgttttggcgcgggatttaaggtgtgttcggcgagtttttgtgtaggggcggttgggcgggggagagttttgagtttgtattggaatttgtagttgagattagttagatcgggttcgtttagaggagggattggaagttggtgtatttgatattcgaagagcgcgaaggggaaacgacgt

SEQ ID NO: 11547 - DNA, 379 bp, Artificial Sequence
  Description of Artificial Sequence: Synthetic polynucleotide
cggtgcgggttcgtttttttttagtttagtttttttgatatcgttttttttttggggacgttgtttgcgggttcgcgcgttttcgttttcgatttttttgtaggttttttcgggggtcggggtaggatcgtatttatcgaggattcgggcgttggagttagtagtagcggtacgagtaggagtagtcgtattttagtttgcgggagacgtattgggttagagcggttcggggttttcgtagttgttttgggcgcgggcgagagtgtgtgggcgcgtttttttttatggtttataggtgattaggagattcgtaataggatagtcgggtgcgtttcggtgtatcgtagagaatatagcgtgagggcgtttcgtcgggcgg

SEQ ID NO: 11548 - DNA, 637 bp, Artificial Sequence
  Description of Artificial Sequence: Synthetic polynucleotide
cgtcgttttatttttaataagtcgaagtttttgaaggaggttcggtgttatttcggtgtgatcgcgtttcggcgacgttgggtagggtgtagggagttagttcggtcgcggtttagcgggaggggagggggtcggtttcgaattcgggcgttcgggtcgcgggtgatttattgggaacgttaggttcgcgcgtttagatcggcgggcgacgtttagcgcgttttacgtttttcgttcgggtcgttcgcgtagaagtagttttcgcgtatttttgtttttcgagacggattcgtcgggaaggagtttggagtcgggcggtcggcgggtagtaatttttttttttttagttattatggtcggtgcgattttttattcgcgttcgtagacggattttttggaaagtatcgggttgggtttatttgattggcgttcgtaggggtcgtcgatttttttatagatttacggaaattgtcggtcgtaagtcgaggttcggtttttagtattcgtcggttcgttcgcgtcggttttttaaagagttgttagatttattcgttagtagtttttttattcgatcgttttgtaggtgcggtgggtttttttttcgttttcgacgcgcgtgcgtattttcgtgtcgcgg

SEQ ID NO: 11549 - DNA, 959 bp, Artificial Sequence
  Description of Artificial Sequence: Synthetic polynucleotide
cgggagtggggcgggtaggaacgagggtttgagtttaggatcgtaattttcgtgaggggttcgaggattttagtttaacgtttcgtcgggtttcgtttttatttttttttttatggcgagttcgtcgaggtttcgtcgtttcgttattcgtttttagcgtcgcgcgggttttgttatcgcgtttacgttcggttaggcggcgatttttcgcgttttgtttcgtcggttgtcgggggtttaagaaatttcgggggggcggggtcgggggcggggtgaggttttcgggggtcggggcggggtcggggagggggcggtggggtcgggggttcggtttagggcgggaaatgggtggggaggggcggggtttgggttggagattggacggaggagtcgggcggagatgtaattggaggaagagggcgggacggggcggagaaggtttttcgtatcggcggagggagagggattaggagggggttgcggcgggggaggagagggggttttcggtttagagattgaggcgagggtggcgggagcggcgcgtaggtagggttggggtggggcgtatatagtgagcgttgggggcgttggcggtggagtttttgaggtttttcgaattagtgggttggggttgcgagatcgagtcgagttgttttgggcggttagagatgtgggtatatagaggttttttttttttttttttcgacgtcgggtagtgggcggtggtttggttttttttttggaatttttgggcggggtcgggtttggagtttgggtttttgttcggagggtggtgttataggaagagttggagttgagagtcgggatttcggggtttttttagggggcggttcgtttttggtttttaggggtttttaagcgtagtgtttttttgttttttttgggtatcgtttaatttttttcgtatttgagggtcgattattttttcgatttcgcgg

SEQ ID NO: 11550 - DNA, 826 bp, Artificial Sequence
  Description of Artificial Sequence: Synthetic polynucleotide
cgtttatttttgcggcgtcgtgaaagaaggcgtaggaggagggagttttgatattttttttcgggttggggttttatagcggcgaaaagacggagggagtgatcgggggtcgcggggattttttcgggacgggttttcgtcggaggagtttcggaaagtcgttttttattttcgaggtttcgtttgcgcgggcgttttattagcggtcggggtggtggcggcggcggcggcggcggcggcggcgcggggcggggcgtcgcgatttttgttttttttttgggtcgagcggtaggcgcgttcgtatcgttttcgttttttcgtcgtagtcgttgtcgatcggttggttgggttttgcggcgtgaggatttcggcggcgtcgtagtttcgcgagttatggtttagttcggcggggaggttcggttcgggtttaagacggcggtgtagattcgcgtcgttatttaggaggtcgaggacgtggacgagttggaggacgaggaggagggggcggagattcggggcgtcggggattcggttcggtattttagtttcggttggggtagcgcgagcgaggaggagtcgagtcgcgggtataggtaggcgcggcggttggttcgggaggtgggtttcgagggggcgtcgggtcgcgcgcgagttcggggcgttgattgcgcgcgataatttttcgggtagagggggttgagttagtttcgtcgtcggggaagtagtttcgggtcgagtttttgagttagaatcggttcgtggaggtagtcggtgttttagttcgtagtttcgtcgtttaatcgaggtttttagggttggcggtcgg

SEQ ID NO: 11551 - DNA, 2156 bp, Artificial Sequence
  Description of Artificial Sequence: Synthetic polynucleotide
cgttcgaggaatcggtttaatcgtttttcgttgtagtcggtttgtttttttttcggaattatcgagggagaggcgcgtgcggaggtcggcgttcggatttcgtattcgttattgttgtcggcgtattttttcgaagttttatttcgaagggttgggttttattcgcgcgttttgtgcgtgtttttttgtttttttacgttttttttgtttggttgttgcgaggttttgtaggggaaagattggcgcggggttcgtattttgtttatgttataggaaaatcgtgggagttttttcgacgcggcgtattttcggaagttttttttttaggagggttgcgggaaggtcgggattttgtatttagacgaattcggtcgttttttaagaggaaagtcggagatttagttgaggggtaaaaatgttagggaaaggcgagtttagagtttggtgatggagaaattgggaagttattttttattttttaattttaggatggggaattcgtaattgaagtcggagttttagatttggggcgtatttttagtttagtttaggaaagagatttaagggcgtagtagtgtggatattttttatttcggtttcgaaggtttagcgagggtttaatttgggttttttgttaggttcgtttttcgtttttttttagttttcggttcgtgcgtcgttgtttttttaagaagtttaggtaggtaggttcggttgttggagtcgtttttatggtaattcgcgagttgcggcggttttatgaatatttcggggcgcgggagttcgagcgttgtcggagggcgtttcgggggaggcggtcgttgatgtaagttcggcgggtcgttgggtttcgttcggttgcggcgggagtttcgggacgggtcggacgggtcggggtagaggaggcgaggcgagttcgcgggtggttagttataaagttcgggcggcgagatagacggatagttagttttttcgcgggacgtacgttcgggattcgcgcgggtcgtgcgttttgtatttcggagcggttttttgagcgtcgcggtcgtagagttttttcggtcggcgtttattgtttttcgcgggggcggggcgtttggagtcgggcggcgcgtcgcgtttttgaacgttagagggagggagggaggtaagaagggagcgcggggttttcgcgtttagtcgggttcgggaggaggtgtagcgcggcgagttcggggattcggagcgggattaggatttttttcgcggcgcgtagtttgtttaagtatgggcgtttgaggttgtttttacgtcggcggtaaaggacgcgtttttacgggcggattgatcggcgggcggatttggagttcgttcgcggcgtcgcgtttttgttttcggttcggttcgatttcggtttttggcgttatggataagttgtcgtcgtttatgcgtaagcggttttatagtttttcgtagtaggtgggggttaaggcgtggattatggacgaggaagaggacgtcgaggaggagggggtcgggggtcgttaagattttagtcgtaggagtattcggttgcggttattgttttcgttttttttttcggcggtcgcgggtggtacggagtttcggagttcggttttcggggtagcggatagcgaagggtcggttcgcggcgcgggtaagtttagtacgaacggcgattgtaggcgttttcgcgggagtttggtttcgttgggtagtcggggcggcggtagcggcggtacggggagcggtagtagttacggatatttgtatgatttcgcggaggagcggcggtttatcgtcgagggcgacgcgtttttcggcgaggataggacgtttttaggtttggcggtcgagttcgagcgtttcggcgtttcggcgtagttcgtagtttcgtcgtcgtcgttttagtagttatcgtagtcggttttcgttttttgcgagtagttttcggtggatatcgttattaaagtggagggaggcgcggttgtcggcgattagattttttcggaggtcgaggtgcgtttgggttaggtcggttttatgtagcgttagttcggggttatgttttaattcggggttaataaattttttttaaggatgttcggtagttagaaagtcgtggagcgcgaataggagagggttaagtcggtcgg

SEQ ID NO: 11552 - DNA, 1441 bp, Artificial Sequence
  Description of Artificial Sequence: Synthetic polynucleotide
cgtaaggaggaaaacgtggaatcgaatatagtagttgcgggatcgtattacgtgatttttttttcgcggtcgttttatagaatttgtgggaaggggggggagggggagtgtcgtcgtaatttcgaggataggttagtagttcgcgggttcgattttagtcggcgttttcggggttattatattttttcgtcggcggggaaattatattttttatacgttcgaagtcgtcgttttttcgatacggttcgttcggtcgtacgtatacgttacgggtcggcgtttttcggtatacgcgcgaaggtcgggtttcgtttcgttttttatcgatttcgcggagcggcgattatcggttttaattagtttcggatttcgggcgcgttcgggtcggtttttttttcggtttagttttcgttaatcgggggatttatttcgttgaattcgtttattcgggagggcgcgttttcgttttattgttttatattcgagggtaatagcggtcgtatcgtttatttgggtcggggggtttttttttcgttttcggtcgattgagtcgggttggggttttcgaggaagcgcgggtcgtcgggcggttggaagtgggggaaggagaggagggggagggggtcgggatatcgggagtcgttttttttttttttcgtcgattgcggttttcgtaggttggtcgggcgttttcgtatattcgtttagttttttatagtttcgcgtttcgttagttttttttttattttatttttatatatttttatttttatatatttatattcggtcgtttttcgtttttttattcgtttgtcgcgcgcgcgcgcgatttcgtttatatatagcgcgcgcgacgtcggcggagatcgtttcgtttttttagatcgaacgtcgttcgttcgtttgttgaggagcggcgcgcgtttcggtttcgtttttttggcgtcgcggcgcggcgggcggggggcggcggtcggaggagttgggggtcgggttagcgcgtcgagtattgtcgagcggatttgatatttgcgtcgagagtcgtttttttagtttttcgttcgtattcgagttatcgttggtttcgggggaagagaggcgatggatcgcgcgcggggagcgaaaagggagcgcgagggcgtttcgaggacgcgtttttttattcgtttttaaatcgtttttattgagaaagggaaacggatggggggggtggggggcgaggtttgtttttaattcgaaatcgcgagattagtttttttcgttgtacgtttttttcgtttttatattttttgtttaggttttattaatttgcgtttggaatttcgatacgagttttttattttttcgggcgtagggttttgtcggtatttcgacgtttttcgtttagttttttcgtcggtcgtcgttcggagttttcgtttacggtggttttttttttcgg

SEQ ID NO: 11553 - DNA, 734 bp, Artificial Sequence
  Description of Artificial Sequence: Synthetic polynucleotide
cgggtttcgttcgttttgtttgcgggtcgatttcgcgacgtcgatcggttcgcgttttcgttttcgagcgtttcggcgggcggagttgcgggtgaggggggggttggtttggggggcgggggtttcgatgacggtatcggagcgcgtcgtattggggatggaaatttgattgtttggttcgggacggcgtttgtagttaggtaggtgagtgtgggtcggagagcgggttaggggcgaggatcgggtgggtggagggaggcgcgcgtttttttttcgcgtaggtttgggtttagtggttttgggagtcggtatttttgggagatttgattcggtatgaggagttcggtatttttgttttttagttttttggaagtttttttttggattggtcggcgtcgttttttcgatatttgggggttgaggtcggtatttcgggtttgcgtggaggggcgagcgttaaggttgcgagagtcgggtttcgatttgtaattattttttttaatttttatggagtttcgtttcgcgttcgtcgtttttagttttagttgttttgtttcggtttcgaatagcgtttgcggggttgttagagtattttcggagcgggagcgttgtgcggagagtaggggcgcgcggaagtcgggattgtatcgggttcggaacgtttacgcggaggggtgcgcgaaggtttatacggtattgcgaggtagagtttatcgttgtgtgtttagggtcgg

SEQ ID NO: 11554 - DNA, 935 bp, Artificial Sequence
  Description of Artificial Sequence: Synthetic polynucleotide
cggcggtgtttagggggagagggttttagcgtcgtcgttttttaagtcgattcgttcgtatttggttttttttttatagggttggagtttggatgaagttttttatttttgttagattttagtcggggggtcggcgtcgcgaggtttttatgcgcgtttttaaagttgtcgcgggggaggggttatttttcgttcggggttgagattagtcgagtttttcgtttttgttcggttcgtttatttcgggcgtatagcgttagtcggagtagttttagtagttgcgtttttagttcgtacgcgtttaggtttagtatggcggcgcgcggttcgggcgtcgcggagtcgtcgaggagtcgtcgttcgtttcgtcgtcgtttcgttcggcgtttagtttcggcgcgattgcggtgagtttatttcggtcgggagcgtttttcgcgtttagtcgcgttcggtagagagtttttagtcgtttcggatttcgcgtagtttcgtagagacgcgcgtgtcgttcgtacgggtcggtattcgggtcgttttcgtcggcgtgttaggatttcgtatagaagcgttcggacgcggacgtacgtagtcgcggttacgattttcgtcgttcgttcggttcgtgttcggttttggttagtagggttgttttatttttacggcgcggcgggagttcgagggggttttttgggaaattttttgcggggcgtcgtggcgtaggtgcgtttttatttttagggttttattattcgcggttatatttggggtcggatcgcgcgttttttttttttttttcgtttttgagggagtttttgtttgggtcgagggggatttcgggggtttgtttagttttggggtgaggggttggtttaatattttataggtttacggttattagtagggcgggattatagtgggcgcgggtcgtacgt

SEQ ID NO: 11555 - DNA, 1054 bp, Artificial Sequence
  Description of Artificial Sequence: Synthetic polynucleotide
cggggtgggggatattcgggttgagttagttaagtcgggagtgtgaggagtagcgggggtcggtaggaacgtggacgcgagattggggagtagtggggttgtttgtgcggggatgtagtttttattaagtatacgggtcgagggttgattataggtagagtagcgttttttggtagcgttgcgggtgtggatgagggaagttaggtttcggatttatatttagacggtcgttttttagtttgtttttttttttttgtgggtttttaaagtgcggtttggtttttttatttcgattttgaggtttggaggtggggacgggattgtgggcgtcggtaaacgtgagttttcgagcggggcgggaaaggagtttcgcgaatgttttttttagtttcggcgttttacgtgtaggtttatgattgggagcgtttttaatttaaatcggtattgcgtcgggattattttttttttggcgtcgttttcgtcgtttttttcggatttttttcggttttttttttatttttcgttttcggggtttttttttgttgagcgggggttgtcgggatttgggattgcggggttgtttcgatttcgtagtcgttcgcggtggaagttagttcgggtttggttttgagcgcgcggttggggcggtcgttgtttatggtgttggcgcgggtggcgcgtcggtcggcggggtttgcggaggtttaggcgtttttggcggggaaggcggcgttttcgggtttggggagcgagggttttcgttttaggggtacggaggatatttagattggggcgttcgtgggtttggtgttgtcgtttcgggcgtcggtattttgcgatatttttttttttcggttttgggagggaatcgaggtagtttcgcgttaggttttttcggatatttggggtaaattcgttttttagagtttcgtgttttttttttaaatttgaggtagcgatttttttatttttaagggcggtcgtgaggtcgaattatgtgtcgattttagtcggtttttgtaaacgttgtgatgtcggttttcggaggtcgcgt

SEQ ID NO: 11556 - DNA, 1474 bp, Artificial Sequence
  Description of Artificial Sequence: Synthetic polynucleotide
cgttagcgtcgatgttgttgttttttcgttttttttatttttatatatttttattcgggttttcgcgggtttttcgaattaagtttttagtttagtttttttaaatagtttatatagcgatacgggtattgggtaattgtaattagttttaatcggaagtatttgtttgtgggtgagatttatttgattttcggggtcggtcgttataagggcgagggttgaggatttttcgtgggggatatgggttttttattagtcggaaagttttagcgatcggttgggcgtttttgggtcggattcgcgtcgtcgttcgcgtattggggttttcgaggtgtgatgttatttgttcgtagaatcggtttttttcgcgtcgtttttttcgcgtttttattttagtttttttttcgtcgttttcggggttaatatggtagcggcgtcgtcgttttattttcgtaatcgtacgattcggttggtagggtcgtcggttcggattttcgagatttatatttcggttaggttcgtacgttttgcgtttcggattttcggcggtttttcgtagttttcggggcgtcgattttcgttcgttgttatacgaggttcgggcgttttcgatagttcgggattacgttagagtgacgttatatatcggatttcggcgagttgcgggtatgagtaacgcgcgcgttttcgttttcgagtttttttcgtcgtcgcgtttatcgttgaagattatggcggtcgaggcgtttatgacggcgaaaaacgaagtatattcggggtcgtttttggattcggatatgtttgcgggtggggagggggtaagttttgtgggtcgaggcggtggcggaggcgggggcgaggacgggtcgggtacgaaggtttgcgggcgggcggcggcgaaggcgattcggttcgttagtcgttgcgttttaaatattagtatcgtagaataaaatggcggtcgcggtcgcgttatatgatttgggtttcgtttttgcgagtcgtattatttcgtatcgtgggggagacgcgttttcgggacgttcggtcggttcgttgatttttttcgggttgtgtcgttcgtttagcgattcggtttcggcgttcggtttcgttttgtttcggttttcgcgggtgttttcgggcgtcgtcggtttttggattttcgtagcgttggatcggtttcgcgtcggggcggggcggtgtggtgtgtgttttattagtatacggggcggggtttcggacgtttcgttttttttgcggttgcgcgtcgtttgtaggtgttgggttttcggcgacgtttttttttgtatttttggcgtgaagttgtaggtcgtggtttcgcggttttgtttttaagacggggttttattttttcgggcgttggttttttaggatttttttattaattttgggcgagttaagggttttagtagatgtgcggcgcgcgggttttttttgttatagcgttcgg

SEQ ID NO: 11557 - DNA, 357 bp, Artificial Sequence
  Description of Artificial Sequence: Synthetic polynucleotide
cgggagatttcgagattttcggtcggtgatagtaggcgattttttgtttttgttaatttgtgggtttttacggacgtggggaagggaggagggaggttttagttttttgcgggggaggggcgtgaagacgcgcgggggtggggggagatgagtcggcgtcgttatgataacgaggtcggtggttcggttttggggattcgggagggagggaggcgtcgtggtcgcgcgcgcgggcgggggcggggggttaggttttttaggagtagttggggaatattcggcgattttggcggttgttttttggtggcgtagggagttcgcgtgtttgcgagtgcgtgtgtgtgcgaagtttttcgg

SEQ ID NO: 11558 - DNA, 814 bp, Artificial Sequence
  Description of Artificial Sequence: Synthetic polynucleotide
cgtcgtttaagagtttggggtcgtggggggcggggttgtttgttatcggtttcgtttcgtcgataggattcgtttttttttttaggttcggcggggtcgatttcgtttttcgtttttagtttgtcgtacgatagcggcggcgcggcgggcggagtcgggaggcggggaagtagtggtcgtgtgagcgtgaggagttgtcgttatcgtttgtttttcgtttttttcgtttttcggggttttagcgtcgtgggtcgcgtacggttttggaagagacgtcgtttcgtttttattcgttttttttatcgcgtcgttttttcgttttgttttgcgggtttaggcggaattcggaacggtcgtttttttttttcgtttttcgtcgtcgttttttttttttttttttcggttttttttttagtttcgggtcggagcggggtgtcggcggcggtcggttcgggcggcggcgtttggttatgtcgtgtcggggaaggtaatgagtcgtagagtttcggggtttcggttgagtagcggcggtattaattattcgcggagttggaatgattggtaatttaggtgggtgatcggttcgggatttcgtttcgatttttcgggtttcgtttcgggcgggtcgaggtttagggtcgcggggttgggaggcgcggtttaggttttttatttatcggagtcgggcgcggttttttgggttttttttttttcggttaggggaggaaggtcgcggggaggcgaggtttaagtgttttttttttttttgtttgtttagttcggggttgaagtcgagtttcggggttttcggcgg

SEQ ID NO: 11559 - DNA, 847 bp, Artificial Sequence
  Description of Artificial Sequence: Synthetic polynucleotide
cgtggtgagatatcgatttcgtagagtagagggggcggcggtagaggggaagggttttcgtatttattttttttgtaggaggtgtatttgtatttttcgtatttgtaggagttcgcgtaggtgtaggagttatttagagagggcgacgttataggaagggttaatgtggacgaattcgggtttttacgtttgttacgaggagatggggtgttaagtttttttgtttttcgcgatataggtatgttcgttttttacgaggtgaagaatagggaattaggggttttttttttaagtgtttttgagcgaaggcgtagggcgtgggtttttttgtaggtataagggcgcgtagtgcgtaggatgcgagcgggggcgggggtttattagaagggtaggggtaggttttagggtttatgtcgaggagagtagtagttggaggcggtgaacgggtttttttaagtaattggacgcgcggtttggttagtggtagtaggtggcgatgtttttatagtttcgggcgggggcgcgtatgttaagttcgttgggcgttcgtttttgcgtatcgcgttcgtttttttcgtttgtgcgtttgggtttcggcgtacgtattgtatttgtcgttcgtttttgtcgtgtgtgtgtattgtcggggttcgttcgtttacgttcgcgcgtgcgtttttatttttatttcgtattcgcgtgtacgatttattcgtcgtcgttgtgcgcgtattgttagtttatttttcgcgtgggtttcgtaggggacgtgttcgtcgtagtagtcgttattgcgtggaagcgcgtacgtattattttcgaaagtggagaaaaaggcgttttgcgt

SEQ ID NO: 11560 - DNA, 589 bp, Artificial Sequence
  Description of Artificial Sequence: Synthetic polynucleotide
cgtgggtgtttcggaggaaacggtcgtagttttaaattttttagtttttttagtagggagttttttcgcggagtttcgtttggcggtcggaagttattttaagtcgtttattcggaagtcgtcgttttggtaattgggtatcgttttattttttttttttagtaacgtttatcgttttagacgtttgaggttagtcgagtttcgattggtttttttgttttttattttgggagacgtttgagatttagcgtttttagatttcgtatttgaatttgtggcgtttggtgttcgcgagttgtcgaatgaagttgagcgttttagtggaattagggattttaggggtgagcgatcgcgaggggagagcgacgaaaagggcggtcggagttggaggggcgcggagttaaataaaaaagggcggtcggagttgtaggggcgtcgagttaaatacgttatttttagatggggggttttaggcgagttgtttagtttttttgaggtaggtttttcgtttgttcgttttttcgtagtttttgagttttttttttacgtcgtttttcggtagttttagagacgttacgtttgttttcgt

SEQ ID NO: 11561 - DNA, 20 bp, Homo sapiens
cgtggtgcgcgcggcgggcg

SEQ ID NO: 11562 - DNA, 116 bp, Homo sapiens; identical to SEQ ID NO: 8448

SEQ ID NO: 11563 - DNA, 44 bp, Homo sapiens; identical to SEQ ID NO: 8459

SEQ ID NO: 11564 - DNA, 34 bp, Homo sapiens; identical to SEQ ID NO: 8470

SEQ ID NO: 11565 - DNA, 211 bp, Homo sapiens; identical to SEQ ID NO: 8481

SEQ ID NO: 11566 - DNA, 95 bp, Homo sapiens; identical to SEQ ID NO: 8492

SEQ ID NO: 11567 - DNA, 264 bp, Homo sapiens; identical to SEQ ID NO: 8503

SEQ ID NO: 11568 - DNA, 59 bp, Homo sapiens; identical to SEQ ID NO: 8514

SEQ ID NO: 11569 - DNA, 4 bp, Homo sapiens
cgcg

SEQ ID NO: 11570 - DNA, 324 bp, Homo sapiens; identical to SEQ ID NO: 8536

SEQ ID NO: 11571 - DNA, 102 bp, Homo sapiens; identical to SEQ ID NO: 8544

SEQ ID NO: 11572 - DNA, 24 bp, Homo sapiens
cgcaacgactcgctgccgcccacg

SEQ ID NO: 11573 - DNA, 521 bp, Homo sapiens; identical to SEQ ID NO: 8546

SEQ ID NO: 11574 - DNA, 1484 bp, Homo sapiens; identical to SEQ ID NO: 8547

SEQ ID NO: 11575 - DNA, 34 bp, Homo sapiens; identical to SEQ ID NO: 8548

SEQ ID NO: 11576 - DNA, 14 bp, Homo sapiens
cggcgaggggctcg

SEQ ID NO: 11577 - DNA, 37 bp, Homo sapiens; identical to SEQ ID NO: 8550

SEQ ID NO: 11578 - DNA, 34 bp, Homo sapiens; identical to SEQ ID NO: 8551

SEQ ID NO: 11579 - DNA, 538 bp, Homo sapiens; identical to SEQ ID NO: 8552

SEQ ID NO: 11580 - DNA, 109 bp, Homo sapiens; identical to SEQ ID NO: 8553

SEQ ID NO: 11581 - DNA, 901 bp, Homo sapiens; identical to SEQ ID NO: 8554

SEQ ID NO: 11582 - DNA, 15 bp, Homo sapiens
cgggcggcgcgggcg

SEQ ID NO: 11583 - DNA, 383 bp, Homo sapiens; identical to SEQ ID NO: 8556

SEQ ID NO: 11584 - DNA, 4 bp, Homo sapiens
cgcg

SEQ ID NO: 11585 - DNA, 624 bp, Homo sapiens; identical to SEQ ID NO: 8558

SEQ ID NO: 11586 - DNA, 94 bp, Homo sapiens; identical to SEQ ID NO: 8559

SEQ ID NO: 11587 - DNA, 63 bp, Homo sapiens; identical to SEQ ID NO: 8560

SEQ ID NO: 11588 - DNA, 41 bp, Homo sapiens; identical to SEQ ID NO: 8561

SEQ ID NO: 11589 - DNA, 1041 bp, Homo sapiens; identical to SEQ ID NO: 8562

SEQ ID NO: 11590 - DNA, 23 bp, Homo sapiens
cgccttcggctcgggccatggcg

SEQ ID NO: 11591 - DNA, 515 bp, Homo sapiens; identical to SEQ ID NO: 8564

SEQ ID NO: 11592 - DNA, 1017 bp, Homo sapiens; identical to SEQ ID NO: 8565

SEQ ID NO: 11593 - DNA, 8 bp, Homo sapiens
cgcgctcg

SEQ ID NO: 11594 - DNA, 54 bp, Homo sapiens; identical to SEQ ID NO: 8567

SEQ ID NO: 11595 - DNA, 10 bp, Homo sapiens
cgcgttgtcg

SEQ ID NO: 11596 - DNA, 26 bp, Homo sapiens
cgggcaggttcgaccaggcggccgcg

SEQ ID NO: 11597 - DNA, 934 bp, Homo sapiens; identical to SEQ ID NO: 8570

SEQ ID NO: 11598 - DNA, 279 bp, Homo sapiens; identical to SEQ ID NO: 8571

SEQ ID NO: 11599 - DNA, 2 bp, Homo sapiens
cg

SEQ ID NO: 11600 - DNA, 9 bp, Homo sapiens
cgccccgcg

SEQ ID NO: 11601 - DNA, 11 bp, Homo sapiens
cgagcgcatcg

SEQ ID NO: 11602 - DNA, 30 bp, Homo sapiens; identical to SEQ ID NO: 8575

SEQ ID NO: 11603 - DNA, 10 bp, Homo sapiens
cgctcccgcg

SEQ ID NO: 11604 - DNA, 56 bp, Homo sapiens; identical to SEQ ID NO: 8577

SEQ ID NO: 11605 - DNA, 98 bp, Homo sapiens; identical to SEQ ID NO: 8578

SEQ ID NO: 11606 - DNA, 33 bp, Homo sapiens; identical to SEQ ID NO: 8579

SEQ ID NO: 11607 - DNA, 48 bp, Homo sapiens; identical to SEQ ID NO: 8580

SEQ ID NO: 11608 - DNA, 42 bp, Homo sapiens; identical to SEQ ID NO: 8589

SEQ ID NO: 11609 - DNA, 40 bp, Homo sapiens; identical to SEQ ID NO: 8600

SEQ ID NO: 11610 - DNA, 2 bp, Homo sapiens
cg

SEQ ID NO: 11611 - DNA, 42 bp, Homo sapiens; identical to SEQ ID NO: 8622

SEQ ID NO: 11612 - DNA, 20 bp, Homo sapiens
cgcccgccgcgcgcaccacg

SEQ ID NO: 11613 - DNA, 116 bp, Homo sapiens; identical to SEQ ID NO: 8634

SEQ ID NO: 11614 - DNA, 44 bp, Homo sapiens; identical to SEQ ID NO: 8645

SEQ ID NO: 11615 - DNA, 34 bp, Homo sapiens; identical to SEQ ID NO: 8656

SEQ ID NO: 11616 - DNA, 211 bp, Homo sapiens; identical to SEQ ID NO: 8667

SEQ ID NO: 11617 - DNA, 95 bp, Homo sapiens; identical to SEQ ID NO: 8678

SEQ ID NO: 11618 - DNA, 264 bp, Homo sapiens; identical to SEQ ID NO: 8689

SEQ ID NO: 11619 - DNA, 59 bp, Homo sapiens; identical to SEQ ID NO: 8700

SEQ ID NO: 11620 - DNA, 4 bp, Homo sapiens
cgcg

SEQ ID NO: 11621 - DNA, 324 bp, Homo sapiens; identical to SEQ ID NO: 8722

SEQ ID NO: 11622 - DNA, 102 bp, Homo sapiens; identical to SEQ ID NO: 8730

SEQ ID NO: 11623 - DNA, 24 bp, Homo sapiens
cgtgggcggcagcgagtcgttgcg

SEQ ID NO: 11624 - DNA, 521 bp, Homo sapiens; identical to SEQ ID NO: 8732

SEQ ID NO: 11625 - DNA, 1484 bp, Homo sapiens; identical to SEQ ID NO: 8733

SEQ ID NO: 11626 - DNA, 34 bp, Homo sapiens; identical to SEQ ID NO: 8734

SEQ ID NO: 11627 - DNA, 14 bp, Homo sapiens
cgagcccctcgccg

SEQ ID NO: 11628 - DNA, 37 bp, Homo sapiens; identical to SEQ ID NO: 8736

SEQ ID NO: 11629 - DNA, 34 bp, Homo sapiens; identical to SEQ ID NO: 8737

SEQ ID NO: 11630 - DNA, 538 bp, Homo sapiens; identical to SEQ ID NO: 8738

SEQ ID NO: 11631 - DNA, 109 bp, Homo sapiens; identical to SEQ ID NO: 8739

SEQ ID NO: 11632 - DNA, 901 bp, Homo sapiens; identical to SEQ ID NO: 8740

SEQ ID NO: 11633 - DNA, 15 bp, Homo sapiens
cgcccgcgccgcccg

SEQ ID NO: 11634 - DNA, 383 bp, Homo sapiens; identical to SEQ ID NO: 8742

SEQ ID NO: 11635 - DNA, 4 bp, Homo sapiens
cgcg

SEQ ID NO: 11636 - DNA, 624 bp, Homo sapiens; identical to SEQ ID NO: 8744

SEQ ID NO: 11637 - DNA, 94 bp, Homo sapiens; identical to SEQ ID NO: 8745

SEQ ID NO: 11638 - DNA, 63 bp, Homo sapiens; identical to SEQ ID NO: 8746

SEQ ID NO: 11639 - DNA, 41 bp, Homo sapiens; identical to SEQ ID NO: 8747

SEQ ID NO: 11640 - DNA, 1041 bp, Homo sapiens; identical to SEQ ID NO: 8748

SEQ ID NO: 11641 - DNA, 23 bp, Homo sapiens
cgccatggcccgagccgaaggcg

SEQ ID NO: 11642 - DNA, 515 bp, Homo sapiens; identical to SEQ ID NO: 8750

SEQ ID NO: 11643 - DNA, 1017 bp, Homo sapiens; identical to SEQ ID NO: 8751

SEQ ID NO: 11644 - DNA, 8 bp, Homo sapiens
cgagcgcg

SEQ ID NO: 11645 - DNA, 54 bp, Homo sapiens; identical to SEQ ID NO: 8753

SEQ ID NO: 11646 - DNA, 10 bp, Homo sapiens
cgacaacgcg

SEQ ID NO: 11647 - DNA, 26 bp, Homo sapiens
cgcggccgcctggtcgaacctgcccg

SEQ ID NO: 11648 - DNA, 934 bp, Homo sapiens; identical to SEQ ID NO: 8756

SEQ ID NO: 11649 - DNA, 279 bp, Homo sapiens; identical to SEQ ID NO: 8757

SEQ ID NO: 11650 - DNA, 2 bp, Homo sapiens
cg

SEQ ID NO: 11651 - DNA, 9 bp, Homo sapiens
cgcggggcg

SEQ ID NO: 11652 - DNA, 11 bp, Homo sapiens
cgatgcgctcg

SEQ ID NO: 11653 - DNA, 30 bp, Homo sapiens; identical to SEQ ID NO: 8761

SEQ ID NO: 11654 - DNA, 10 bp, Homo sapiens
cgcgggagcg

SEQ ID NO: 11655 - DNA, 56 bp, Homo sapiens; identical to SEQ ID NO: 8763

SEQ ID NO: 11656 - DNA, 98 bp, Homo sapiens; identical to SEQ ID NO: 8764

SEQ ID NO: 11657 - DNA, 33 bp, Homo sapiens; identical to SEQ ID NO: 8765

SEQ ID NO: 11658 - DNA, 48 bp, Homo sapiens; identical to SEQ ID NO: 8766

SEQ ID NO: 11659 - DNA, 42 bp, Homo sapiens; identical to SEQ ID NO: 8775

SEQ ID NO: 11660 - DNA, 40 bp, Homo sapiens; identical to SEQ ID NO: 8786

SEQ ID NO: 11661 - DNA, 2 bp, Homo sapiens
cg

SEQ ID NO: 11662 - DNA, 42 bp, Homo sapiens; identical to SEQ ID NO: 8808

SEQ ID NO: 11663 - DNA, 20 bp, Artificial Sequence
  Description of Artificial Sequence: Synthetic oligonucleotide
ygtggtgygygyggygggyg

SEQ ID NO: 11664 - DNA, 116 bp, Artificial Sequence; identical to SEQ ID NO: 8820
  Description of Artificial Sequence: Synthetic polynucleotide

SEQ ID NO: 11665 - DNA, 44 bp, Artificial Sequence; identical to SEQ ID NO: 8831
  Description of Artificial Sequence: Synthetic oligonucleotide

SEQ ID NO: 11666 - DNA, 34 bp, Artificial Sequence; identical to SEQ ID NO: 8842
  Description of Artificial Sequence: Synthetic oligonucleotide

SEQ ID NO: 11667 - DNA, 211 bp, Artificial Sequence; identical to SEQ ID NO: 8853
  Description of Artificial Sequence: Synthetic polynucleotide

SEQ ID NO: 11668 - DNA, 95 bp, Artificial Sequence; identical to SEQ ID NO: 8864
  Description of Artificial Sequence: Synthetic oligonucleotide

SEQ ID NO: 11669 - DNA, 264 bp, Artificial Sequence; identical to SEQ ID NO: 8875
  Description of Artificial Sequence: Synthetic polynucleotide

SEQ ID NO: 11670 - DNA, 59 bp, Artificial Sequence; identical to SEQ ID NO: 8886
  Description of Artificial Sequence: Synthetic oligonucleotide

SEQ ID NO: 11671 - DNA, 4 bp, Artificial Sequence
  Description of Artificial Sequence: Synthetic oligonucleotide
ygyg

SEQ ID NO: 11672 - DNA, 324 bp, Artificial Sequence; identical to SEQ ID NO: 8908
  Description of Artificial Sequence: Synthetic polynucleotide

SEQ ID NO: 11673 - DNA, 102 bp, Artificial Sequence; identical to SEQ ID NO: 8916
  Description of Artificial Sequence: Synthetic polynucleotide

SEQ ID NO: 11674 - DNA, 24 bp, Artificial Sequence
  Description of Artificial Sequence: Synthetic oligonucleotide
ygtaaygattygttgtygtttayg

SEQ ID NO: 11675 - DNA, 521 bp, Artificial Sequence; identical to SEQ ID NO: 8918
  Description of Artificial Sequence: Synthetic polynucleotide

SEQ ID NO: 11676 - DNA, 1484 bp, Artificial Sequence; identical to SEQ ID NO: 8919
  Description of Artificial Sequence: Synthetic polynucleotide

SEQ ID NO: 11677 - DNA, 34 bp, Artificial Sequence; identical to SEQ ID NO: 8920
  Description of Artificial Sequence: Synthetic oligonucleotide

SEQ ID NO: 11678 - DNA, 14 bp, Artificial Sequence
  Description of Artificial Sequence: Synthetic oligonucleotide
yggygaggggttyg

SEQ ID NO: 11679 - DNA, 37 bp, Artificial Sequence; identical to SEQ ID NO: 8922
  Description of Artificial Sequence: Synthetic oligonucleotide

SEQ ID NO: 11680 - DNA, 34 bp, Artificial Sequence; identical to SEQ ID NO: 8923
  Description of Artificial Sequence: Synthetic oligonucleotide

SEQ ID NO: 11681 - DNA, 538 bp, Artificial Sequence; identical to SEQ ID NO: 8924
  Description of Artificial Sequence: Synthetic polynucleotide

SEQ ID NO: 11682 - DNA, 109 bp, Artificial Sequence; identical to SEQ ID NO: 8925
  Description of Artificial Sequence: Synthetic polynucleotide

SEQ ID NO: 11683 - DNA, 901 bp, Artificial Sequence; identical to SEQ ID NO: 8926
  Description of Artificial Sequence: Synthetic polynucleotide

SEQ ID NO: 11684 - DNA, 15 bp, Artificial Sequence
  Description of Artificial Sequence: Synthetic oligonucleotide
ygggyggygygggyg

SEQ ID NO: 11685 - DNA, 383 bp, Artificial Sequence; identical to SEQ ID NO: 8928
  Description of Artificial Sequence: Synthetic polynucleotide

SEQ ID NO: 11686 - DNA, 4 bp, Artificial Sequence
  Description of Artificial Sequence: Synthetic oligonucleotide
ygyg

SEQ ID NO: 11687 - DNA, 624 bp, Artificial Sequence; identical to SEQ ID NO: 8930
  Description of Artificial Sequence: Synthetic polynucleotide

SEQ ID NO: 11688 - DNA, 94 bp, Artificial Sequence; identical to SEQ ID NO: 8931
  Description of Artificial Sequence: Synthetic oligonucleotide

SEQ ID NO: 11689 - DNA, 63 bp, Artificial Sequence; identical to SEQ ID NO: 8932
  Description of Artificial Sequence: Synthetic oligonucleotide

SEQ ID NO: 11690 - DNA, 41 bp, Artificial Sequence; identical to SEQ ID NO: 8933
  Description of Artificial Sequence: Synthetic oligonucleotide

SEQ ID NO: 11691 - DNA, 1041 bp, Artificial Sequence; identical to SEQ ID NO: 8934
  Description of Artificial Sequence: Synthetic polynucleotide

SEQ ID NO: 11692 - DNA, 23 bp, Artificial Sequence
  Description of Artificial Sequence: Synthetic oligonucleotide
ygttttyggttygggttatggyg

SEQ ID NO: 11693 - DNA, 515 bp, Artificial Sequence; identical to SEQ ID NO: 8936
  Description of Artificial Sequence: Synthetic polynucleotide

SEQ ID NO: 11694 - DNA, 1017 bp, Artificial Sequence; identical to SEQ ID NO: 8937
  Description of Artificial Sequence: Synthetic polynucleotide

SEQ ID NO: 11695 - DNA, 8 bp, Artificial Sequence
  Description of Artificial Sequence: Synthetic oligonucleotide
ygygttyg

SEQ ID NO: 11696 - DNA, 54 bp, Artificial Sequence; identical to SEQ ID NO: 8939
  Description of Artificial Sequence: Synthetic oligonucleotide

SEQ ID NO: 11697 - DNA, 10 bp, Artificial Sequence
  Description of Artificial Sequence: Synthetic oligonucleotide
ygygttgtyg

SEQ ID NO: 11698 - DNA, 26 bp, Artificial Sequence
  Description of Artificial Sequence: Synthetic oligonucleotide
ygggtaggttygattaggyggtygyg

SEQ ID NO: 11699 - DNA, 934 bp, Artificial Sequence; identical to SEQ ID NO: 8942
  Description of Artificial Sequence: Synthetic polynucleotide

SEQ ID NO: 11700 - DNA, 279 bp, Artificial Sequence; identical to SEQ ID NO: 8943
  Description of Artificial Sequence: Synthetic polynucleotide

SEQ ID NO: 11701 - DNA, 2 bp, Artificial Sequence
  Description of Artificial Sequence: Synthetic oligonucleotide
yg

SEQ ID NO: 11702 - DNA, 9 bp, Artificial Sequence
  Description of Artificial Sequence: Synthetic oligonucleotide
ygtttygyg

SEQ ID NO: 11703 - DNA, 11 bp, Artificial Sequence
  Description of Artificial Sequence: Synthetic oligonucleotide
ygagygtatyg

SEQ ID NO: 11704 - DNA, 30 bp, Artificial Sequence; identical to SEQ ID NO: 8947
  Description of Artificial Sequence: Synthetic oligonucleotide

SEQ ID NO: 11705 - DNA, 10 bp, Artificial Sequence
  Description of Artificial Sequence: Synthetic oligonucleotide
ygttttygyg

SEQ ID NO: 11706 - DNA, 56 bp, Artificial Sequence; identical to SEQ ID NO: 8949
  Description of Artificial Sequence: Synthetic oligonucleotide

SEQ ID NO: 11707 - DNA, 98 bp, Artificial Sequence; identical to SEQ ID NO: 8950
  Description of Artificial Sequence: Synthetic oligonucleotide

SEQ ID NO: 11708 - DNA, 33 bp, Artificial Sequence; identical to SEQ ID NO: 8951
  Description of Artificial Sequence: Synthetic oligonucleotide

SEQ ID NO: 11709 - DNA, 48 bp, Artificial Sequence; identical to SEQ ID NO: 8952
  Description of Artificial Sequence: Synthetic oligonucleotide

SEQ ID NO: 11710 - DNA, 42 bp, Artificial Sequence; identical to SEQ ID NO: 8961
  Description of Artificial Sequence: Synthetic oligonucleotide

SEQ ID NO: 11711 - DNA, 40 bp, Artificial Sequence; identical to SEQ ID NO: 8972
  Description of Artificial Sequence: Synthetic oligonucleotide

SEQ ID NO: 11712 - DNA, 2 bp, Artificial Sequence
  Description of Artificial Sequence: Synthetic oligonucleotide
yg

SEQ ID NO: 11713 - DNA, 42 bp, Artificial Sequence; identical to SEQ ID NO: 8994
  Description of Artificial Sequence: Synthetic oligonucleotide

SEQ ID NO: 11714 - DNA, 20 bp, Artificial Sequence
  Description of Artificial Sequence: Synthetic oligonucleotide
cgtggtgcgcgcggcgggcg

SEQ ID NO: 11715 - DNA, 116 bp, Artificial Sequence; identical to SEQ ID NO: 9006
  Description of Artificial Sequence: Synthetic polynucleotide

SEQ ID NO: 11716 - DNA, 44 bp, Artificial Sequence; identical to SEQ ID NO: 9017
  Description of Artificial Sequence: Synthetic oligonucleotide

SEQ ID NO: 11717 - DNA, 34 bp, Artificial Sequence; identical to SEQ ID NO: 9028
  Description of Artificial Sequence: Synthetic oligonucleotide

SEQ ID NO: 11718 - DNA, 211 bp, Artificial Sequence; identical to SEQ ID NO: 9039
  Description of Artificial Sequence: Synthetic polynucleotide

SEQ ID NO: 11719 - DNA, 95 bp, Artificial Sequence; identical to SEQ ID NO: 9050
  Description of Artificial Sequence: Synthetic oligonucleotide

SEQ ID NO: 11720 - DNA, 264 bp, Artificial Sequence; identical to SEQ ID NO: 9061
  Description of Artificial Sequence: Synthetic polynucleotide

SEQ ID NO: 11721 - DNA, 59 bp, Artificial Sequence; identical to SEQ ID NO: 9072
  Description of Artificial Sequence: Synthetic oligonucleotide

SEQ ID NO: 11722 - DNA, 4 bp, Artificial Sequence
  Description of Artificial Sequence: Synthetic oligonucleotide
cgcg

SEQ ID NO: 11723 - DNA, 324 bp, Artificial Sequence; identical to SEQ ID NO: 9094
  Description of Artificial Sequence: Synthetic polynucleotide

SEQ ID NO: 11724 - DNA, 102 bp, Artificial Sequence; identical to SEQ ID NO: 9102
  Description of Artificial Sequence: Synthetic polynucleotide

SEQ ID NO: 11725 - DNA, 24 bp, Artificial Sequence
  Description of Artificial Sequence: Synthetic oligonucleotide
cgtaacgattcgttgtcgtttacg

SEQ ID NO: 11726 - DNA, 521 bp, Artificial Sequence; identical to SEQ ID NO: 9104
  Description of Artificial Sequence: Synthetic polynucleotide

SEQ ID NO: 11727 - DNA, 1484 bp, Artificial Sequence; identical to SEQ ID NO: 9105
  Description of Artificial Sequence: Synthetic polynucleotide

SEQ ID NO: 11728 - DNA, 34 bp, Artificial Sequence; identical to SEQ ID NO: 9106
  Description of Artificial Sequence: Synthetic oligonucleotide

SEQ ID NO: 11729 - DNA, 14 bp, Artificial Sequence
  Description of Artificial Sequence: Synthetic oligonucleotide
cggcgaggggttcg

SEQ ID NO: 11730 - DNA, 37 bp, Artificial Sequence; identical to SEQ ID NO: 9108
  Description of Artificial Sequence: Synthetic oligonucleotide

SEQ ID NO: 11731 - DNA, 34 bp, Artificial Sequence; identical to SEQ ID NO: 9109
  Description of Artificial Sequence: Synthetic oligonucleotide

SEQ ID NO: 11732 - DNA, 538 bp, Artificial Sequence; identical to SEQ ID NO: 9110
  Description of Artificial Sequence: Synthetic polynucleotide

SEQ ID NO: 11733 - DNA, 109 bp, Artificial Sequence; identical to SEQ ID NO: 9111
  Description of Artificial Sequence: Synthetic polynucleotide

SEQ ID NO: 11734 - DNA, 901 bp, Artificial Sequence; identical to SEQ ID NO: 9112
  Description of Artificial Sequence: Synthetic polynucleotide

SEQ ID NO: 11735 - DNA, 15 bp, Artificial Sequence
  Description of Artificial Sequence: Synthetic oligonucleotide
cgggcggcgcgggcg

SEQ ID NO: 11736 - DNA, 383 bp, Artificial Sequence; identical to SEQ ID NO: 9114
  Description of Artificial Sequence: Synthetic polynucleotide

SEQ ID NO: 11737 - DNA, 4 bp, Artificial Sequence
  Description of Artificial Sequence: Synthetic oligonucleotide
cgcg

SEQ ID NO: 11738 - DNA, 624 bp, Artificial Sequence; identical to SEQ ID NO: 9116
  Description of Artificial Sequence: Synthetic polynucleotide

SEQ ID NO: 11739 - DNA, 94 bp, Artificial Sequence; identical to SEQ ID NO: 9117
  Description of Artificial Sequence: Synthetic oligonucleotide

SEQ ID NO: 11740 - DNA, 63 bp, Artificial Sequence; identical to SEQ ID NO: 9118
  Description of Artificial Sequence: Synthetic oligonucleotide

SEQ ID NO: 11741 - DNA, 41 bp, Artificial Sequence; identical to SEQ ID NO: 9119
  Description of Artificial Sequence: Synthetic oligonucleotide

SEQ ID NO: 11742 - DNA, 1041 bp, Artificial Sequence; identical to SEQ ID NO: 9120
  Description of Artificial Sequence: Synthetic polynucleotide

SEQ ID NO: 11743 - DNA, 23 bp, Artificial Sequence
  Description of Artificial Sequence: Synthetic oligonucleotide
cgttttcggttcgggttatggcg

SEQ ID NO: 11744 - DNA, 515 bp, Artificial Sequence; identical to SEQ ID NO: 9122
  Description of Artificial Sequence: Synthetic polynucleotide

SEQ ID NO: 11745 - DNA, 1017 bp, Artificial Sequence; identical to SEQ ID NO: 9123
  Description of Artificial Sequence: Synthetic polynucleotide

SEQ ID NO: 11746 - DNA, 8 bp, Artificial Sequence
  Description of Artificial Sequence: Synthetic oligonucleotide
cgcgttcg

SEQ ID NO: 11747 - DNA, 54 bp, Artificial Sequence; identical to SEQ ID NO: 9125
  Description of Artificial Sequence: Synthetic oligonucleotide

SEQ ID NO: 11748 - DNA, 10 bp, Artificial Sequence
  Description of Artificial Sequence: Synthetic oligonucleotide
cgcgttgtcg

SEQ ID NO: 11749 - DNA, 26 bp, Artificial Sequence
  Description of Artificial Sequence: Synthetic oligonucleotide
cgggtaggttcgattaggcggtcgcg

SEQ ID NO: 11750 - DNA, 934 bp, Artificial Sequence; identical to SEQ ID NO: 9128
  Description of Artificial Sequence: Synthetic polynucleotide

SEQ ID NO: 11751 - DNA, 279 bp, Artificial Sequence; identical to SEQ ID NO: 9129
  Description of Artificial Sequence: Synthetic polynucleotide

SEQ ID NO: 11752 - DNA, 2 bp, Artificial Sequence
  Description of Artificial Sequence: Synthetic oligonucleotide
cg

SEQ ID NO: 11753 - DNA, 9 bp, Artificial Sequence
  Description of Artificial Sequence: Synthetic oligonucleotide
cgtttcgcg

SEQ ID NO: 11754 - DNA, 11 bp, Artificial Sequence
  Description of Artificial Sequence: Synthetic oligonucleotide
cgagcgtatcg

SEQ ID NO: 11755 - DNA, 30 bp, Artificial Sequence; identical to SEQ ID NO: 9133
  Description of Artificial Sequence: Synthetic oligonucleotide

SEQ ID NO: 11756 - DNA, 10 bp, Artificial Sequence
  Description of Artificial Sequence: Synthetic oligonucleotide
cgttttcgcg

SEQ ID NO: 11757 - DNA, 56 bp, Artificial Sequence; identical to SEQ ID NO: 9135
  Description of Artificial Sequence: Synthetic oligonucleotide

SEQ ID NO: 11758 - DNA, 98 bp, Artificial Sequence; identical to SEQ ID NO: 9136
  Description of Artificial Sequence: Synthetic oligonucleotide

SEQ ID NO: 11759 - DNA, 33 bp, Artificial Sequence; identical to SEQ ID NO: 9137
  Description of Artificial Sequence: Synthetic oligonucleotide

SEQ ID NO: 11760 - DNA, 48 bp, Artificial Sequence; identical to SEQ ID NO: 9138
  Description of Artificial Sequence: Synthetic oligonucleotide

SEQ ID NO: 11761 - DNA, 42 bp, Artificial Sequence; identical to SEQ ID NO: 9147
  Description of Artificial Sequence: Synthetic oligonucleotide

SEQ ID NO: 11762 - DNA, 40 bp, Artificial Sequence; identical to SEQ ID NO: 9158
  Description of Artificial Sequence: Synthetic oligonucleotide

SEQ ID NO: 11763 - DNA, 2 bp, Artificial Sequence
  Description of Artificial Sequence: Synthetic oligonucleotide
cg

SEQ ID NO: 11764 - DNA, 42 bp, Artificial Sequence; identical to SEQ ID NO: 9180
  Description of Artificial Sequence: Synthetic oligonucleotide

SEQ ID NO: 11765 - DNA, 20 bp, Artificial Sequence
  Description of Artificial Sequence: Synthetic oligonucleotide
ygttygtygygygtattayg

SEQ ID NO: 11766 - DNA, 116 bp, Artificial Sequence; identical to SEQ ID NO: 9192
  Description of Artificial Sequence: Synthetic polynucleotide

SEQ ID NO: 11767 - DNA, 44 bp, Artificial Sequence; identical to SEQ ID NO: 9203
  Description of Artificial Sequence: Synthetic oligonucleotide

SEQ ID NO: 11768 - DNA, 34 bp, Artificial Sequence; identical to SEQ ID NO: 9214
  Description of Artificial Sequence: Synthetic oligonucleotide

SEQ ID NO: 11769 - DNA, 211 bp, Artificial Sequence; identical to SEQ ID NO: 9225
  Description of Artificial Sequence: Synthetic polynucleotide

SEQ ID NO: 11770 - DNA, 95 bp, Artificial Sequence; identical to SEQ ID NO: 9236
  Description of Artificial Sequence: Synthetic oligonucleotide

SEQ ID NO: 11771 - DNA, 264 bp, Artificial Sequence; identical to SEQ ID NO: 9247
  Description of Artificial Sequence: Synthetic polynucleotide

SEQ ID NO: 11772 - DNA, 59 bp, Artificial Sequence; identical to SEQ ID NO: 9258
  Description of Artificial Sequence: Synthetic oligonucleotide

SEQ ID NO: 11773 - DNA, 4 bp, Artificial Sequence
  Description of Artificial Sequence: Synthetic oligonucleotide
ygyg

SEQ ID NO: 11774 - DNA, 324 bp, Artificial Sequence; identical to SEQ ID NO: 9280
  Description of Artificial Sequence: Synthetic polynucleotide

SEQ ID NO: 11775 - DNA, 102 bp, Artificial Sequence; identical to SEQ ID NO: 9288
  Description of Artificial Sequence: Synthetic polynucleotide

SEQ ID NO: 11776 - DNA, 24 bp, Artificial Sequence
  Description of Artificial Sequence: Synthetic oligonucleotide
ygtgggyggtagygagtygttgyg

SEQ ID NO: 11777 - DNA, 521 bp, Artificial Sequence; identical to SEQ ID NO: 9290
  Description of Artificial Sequence: Synthetic polynucleotide

SEQ ID NO: 11778 - DNA, 1484 bp, Artificial Sequence; identical to SEQ ID NO: 9291
  Description of Artificial Sequence: Synthetic polynucleotide

SEQ ID NO: 11779 - DNA, 34 bp, Artificial Sequence; identical to SEQ ID NO: 9292
  Description of Artificial Sequence: Synthetic oligonucleotide

SEQ ID NO: 11780 - DNA, 14 bp, Artificial Sequence
  Description of Artificial Sequence: Synthetic oligonucleotide
ygagtttttygtyg

SEQ ID NO: 11781 - DNA, 37 bp, Artificial Sequence; identical to SEQ ID NO: 9294
  Description of Artificial Sequence: Synthetic oligonucleotide

SEQ ID NO: 11782 - DNA, 34 bp, Artificial Sequence; identical to SEQ ID NO: 9295
  Description of Artificial Sequence: Synthetic oligonucleotide

SEQ ID NO: 11783 - DNA, 538 bp, Artificial Sequence; identical to SEQ ID NO: 9296
  Description of Artificial Sequence: Synthetic polynucleotide

SEQ ID NO: 11784 - DNA, 109 bp, Artificial Sequence; identical to SEQ ID NO: 9297
  Description of Artificial Sequence: Synthetic polynucleotide

SEQ ID NO: 11785 - DNA, 901 bp, Artificial Sequence; identical to SEQ ID NO: 9298
  Description of Artificial Sequence: Synthetic polynucleotide

SEQ ID NO: 11786 - DNA, 15 bp, Artificial Sequence
  Description of Artificial Sequence: Synthetic oligonucleotide
ygttygygtygttyg

SEQ ID NO: 11787 - DNA, 383 bp, Artificial Sequence; identical to SEQ ID NO: 9300
  Description of Artificial Sequence: Synthetic polynucleotide

SEQ ID NO: 11788 - DNA, 4 bp, Artificial Sequence
  Description of Artificial Sequence: Synthetic oligonucleotide
ygyg

SEQ ID NO: 11789 - DNA, 624 bp, Artificial Sequence; identical to SEQ ID NO: 9302
  Description of Artificial Sequence: Synthetic polynucleotide

SEQ ID NO: 11790 - DNA, 94 bp, Artificial Sequence; identical to SEQ ID NO: 9303
  Description of Artificial Sequence: Synthetic oligonucleotide

SEQ ID NO: 11791 - DNA, 63 bp, Artificial Sequence; identical to SEQ ID NO: 9304
  Description of Artificial Sequence: Synthetic oligonucleotide

SEQ ID NO: 11792 - DNA, 41 bp, Artificial Sequence; identical to SEQ ID NO: 9305
  Description of Artificial Sequence: Synthetic oligonucleotide

SEQ ID NO: 11793 - DNA, 1041 bp, Artificial Sequence; identical to SEQ ID NO: 9306
  Description of Artificial Sequence: Synthetic polynucleotide

SEQ ID NO: 11794 - DNA, 23 bp, Artificial Sequence
  Description of Artificial Sequence: Synthetic oligonucleotide
ygttatggttygagtygaaggyg

SEQ ID NO: 11795 - DNA, 515 bp, Artificial Sequence; identical to SEQ ID NO: 9308
  Description of Artificial Sequence: Synthetic polynucleotide

SEQ ID NO: 11796 - DNA, 1017 bp, Artificial Sequence; identical to SEQ ID NO: 9309
  Description of Artificial Sequence: Synthetic polynucleotide

SEQ ID NO: 11797 - DNA, 8 bp, Artificial Sequence
  Description of Artificial Sequence: Synthetic oligonucleotide
ygagygyg

SEQ ID NO: 11798 - DNA, 54 bp, Artificial Sequence; identical to SEQ ID NO: 9311
  Description of Artificial Sequence: Synthetic oligonucleotide

SEQ ID NO: 11799 - DNA, 10 bp, Artificial Sequence
  Description of Artificial Sequence: Synthetic oligonucleotide
ygataaygyg

SEQ ID NO: 11800 - DNA, 26 bp, Artificial Sequence
  Description of Artificial Sequence: Synthetic oligonucleotide
ygyggtygtttggtygaatttgttyg

SEQ ID NO: 11801 - DNA, 934 bp, Artificial Sequence; identical to SEQ ID NO: 9314
  Description of Artificial Sequence: Synthetic polynucleotide

SEQ ID NO: 11802 - DNA, 279 bp, Artificial Sequence; identical to SEQ ID NO: 9315
  Description of Artificial Sequence: Synthetic polynucleotide

SEQ ID NO: 11803 - DNA, 2 bp, Artificial Sequence
  Description of Artificial Sequence: Synthetic oligonucleotide
yg

SEQ ID NO: 11804 - DNA, 9 bp, Artificial Sequence
  Description of Artificial Sequence: Synthetic oligonucleotide
ygyggggyg

SEQ ID NO: 11805 - DNA, 11 bp, Artificial Sequence
  Description of Artificial Sequence: Synthetic oligonucleotide
ygatgygttyg

SEQ ID NO: 11806 - DNA, 30 bp, Artificial Sequence; identical to SEQ ID NO: 9319
  Description of Artificial Sequence: Synthetic oligonucleotide

SEQ ID NO: 11807 - DNA, 10 bp, Artificial Sequence
  Description of Artificial Sequence: Synthetic oligonucleotide
ygygggagyg

SEQ ID NO: 11808 - DNA, 56 bp, Artificial Sequence; identical to SEQ ID NO: 9321
  Description of Artificial Sequence: Synthetic oligonucleotide

SEQ ID NO: 11809 - DNA, 98 bp, Artificial Sequence; identical to SEQ ID NO: 9322
  Description of Artificial Sequence: Synthetic oligonucleotide

SEQ ID NO: 11810 - DNA, 33 bp, Artificial Sequence; identical to SEQ ID NO: 9323
  Description of Artificial Sequence: Synthetic oligonucleotide

SEQ ID NO: 11811 - DNA, 48 bp, Artificial Sequence; identical to SEQ ID NO: 9324
  Description of Artificial Sequence: Synthetic oligonucleotide

SEQ ID NO: 11812 - DNA, 42 bp, Artificial Sequence; identical to SEQ ID NO: 9333
  Description of Artificial Sequence: Synthetic oligonucleotide

SEQ ID NO: 11813 - DNA, 40 bp, Artificial Sequence; identical to SEQ ID NO: 9344
  Description of Artificial Sequence: Synthetic oligonucleotide

SEQ ID NO: 11814 - DNA, 2 bp, Artificial Sequence
  Description of Artificial Sequence: Synthetic oligonucleotide
yg

SEQ ID NO: 11815 - DNA, 42 bp, Artificial Sequence; identical to SEQ ID NO: 9366
  Description of Artificial Sequence: Synthetic oligonucleotide

SEQ ID NO: 11816 - DNA, 20 bp, Artificial Sequence
  Description of Artificial Sequence: Synthetic oligonucleotide
cgttcgtcgcgcgtattacg

SEQ ID NO: 11817 - DNA, 116 bp, Artificial Sequence; identical to SEQ ID NO: 9378
  Description of Artificial Sequence: Synthetic polynucleotide

SEQ ID NO: 11818 - DNA, 44 bp, Artificial Sequence; identical to SEQ ID NO: 9389
  Description of Artificial Sequence: Synthetic oligonucleotide

SEQ ID NO: 11819 - DNA, 34 bp, Artificial Sequence; identical to SEQ ID NO: 9400
  Description of Artificial Sequence: Synthetic oligonucleotide

SEQ ID NO: 11820 - DNA, 211 bp, Artificial Sequence; identical to SEQ ID NO: 9411
  Description of Artificial Sequence: Synthetic polynucleotide

SEQ ID NO: 11821 - DNA, 95 bp, Artificial Sequence; identical to SEQ ID NO: 9422
  Description of Artificial Sequence: Synthetic oligonucleotide

SEQ ID NO: 11822 - DNA, 264 bp, Artificial Sequence; identical to SEQ ID NO: 9433
  Description of Artificial Sequence: Synthetic polynucleotide

SEQ ID NO: 11823 - DNA, 59 bp, Artificial Sequence; identical to SEQ ID NO: 9444
  Description of Artificial Sequence: Synthetic oligonucleotide

SEQ ID NO: 11824 - DNA, 4 bp, Artificial Sequence
  Description of Artificial Sequence: Synthetic oligonucleotide
cgcg

SEQ ID NO: 11825 - DNA, 324 bp, Artificial Sequence; identical to SEQ ID NO: 9466
  Description of Artificial Sequence: Synthetic polynucleotide

SEQ ID NO: 11826 - DNA, 102 bp, Artificial Sequence; identical to SEQ ID NO: 9474
  Description of Artificial Sequence: Synthetic polynucleotide

SEQ ID NO: 11827 - DNA, 24 bp, Artificial Sequence
  Description of Artificial Sequence: Synthetic oligonucleotide
cgtgggcggtagcgagtcgttgcg

SEQ ID NO: 11828 - DNA, 521 bp, Artificial Sequence; identical to SEQ ID NO: 9476
  Description of Artificial Sequence: Synthetic polynucleotide

SEQ ID NO: 11829 - DNA, 1484 bp, Artificial Sequence; identical to SEQ ID NO: 9477
  Description of Artificial Sequence: Synthetic polynucleotide

SEQ ID NO: 11830 - DNA, 34 bp, Artificial Sequence; identical to SEQ ID NO: 8734
  Description of Artificial Sequence: Synthetic oligonucleotide

SEQ ID NO: 11831 - DNA, 14 bp, Artificial Sequence
  Description of Artificial Sequence: Synthetic oligonucleotide
cgagtttttcgtcg

SEQ ID NO: 11832 - DNA, 37 bp, Artificial Sequence; identical to SEQ ID NO: 9480
  Description of Artificial Sequence: Synthetic oligonucleotide

SEQ ID NO: 11833 - DNA, 34 bp, Artificial Sequence; identical to SEQ ID NO: 9481
  Description of Artificial Sequence: Synthetic oligonucleotide

SEQ ID NO: 11834 - DNA, 538 bp, Artificial Sequence; identical to SEQ ID NO: 9482
  Description of Artificial Sequence: Synthetic polynucleotide

SEQ ID NO: 11835 - DNA, 109 bp, Artificial Sequence; identical to SEQ ID NO: 9483
  Description of Artificial Sequence: Synthetic polynucleotide

SEQ ID NO: 11836 - DNA, 901 bp, Artificial Sequence; identical to SEQ ID NO: 9484
  Description of Artificial Sequence: Synthetic polynucleotide

SEQ ID NO: 11837 - DNA, 15 bp, Artificial Sequence
  Description of Artificial Sequence: Synthetic oligonucleotide
cgttcgcgtcgttcg

SEQ ID NO: 11838 - DNA, 383 bp, Artificial Sequence; identical to SEQ ID NO: 9486
  Description of Artificial Sequence: Synthetic polynucleotide

SEQ ID NO: 11839 - DNA, 4 bp, Artificial Sequence
  Description of Artificial Sequence: Synthetic oligonucleotide
cgcg

SEQ ID NO: 11840 - DNA, 624 bp, Artificial Sequence; identical to SEQ ID NO: 9488
  Description of Artificial Sequence: Synthetic polynucleotide

SEQ ID NO: 11841 - DNA, 94 bp, Artificial Sequence; identical to SEQ ID NO: 9489
  Description of Artificial Sequence: Synthetic oligonucleotide

SEQ ID NO: 11842 - DNA, 63 bp, Artificial Sequence; identical to SEQ ID NO: 9490
  Description of Artificial Sequence: Synthetic oligonucleotide

SEQ ID NO: 11843 - DNA, 41 bp, Artificial Sequence; identical to SEQ ID NO: 9491
  Description of Artificial Sequence: Synthetic oligonucleotide

SEQ ID NO: 11844 - DNA, 1041 bp, Artificial Sequence; identical to SEQ ID NO: 9492
  Description of Artificial Sequence: Synthetic polynucleotide

SEQ ID NO: 11845 - DNA, 23 bp, Artificial Sequence
  Description of Artificial Sequence: Synthetic oligonucleotide
cgttatggttcgagtcgaaggcg

SEQ ID NO: 11846 - DNA, 515 bp, Artificial Sequence; identical to SEQ ID NO: 9494
  Description of Artificial Sequence: Synthetic polynucleotide

SEQ ID NO: 11847 - DNA, 1017 bp, Artificial Sequence; identical to SEQ ID NO: 9495
  Description of Artificial Sequence: Synthetic polynucleotide

SEQ ID NO: 11848 - DNA, 8 bp, Artificial Sequence
  Description of Artificial Sequence: Synthetic oligonucleotide
cgagcgcg

SEQ ID NO: 11849 - DNA, 54 bp, Artificial Sequence; identical to SEQ ID NO: 9497
  Description of Artificial Sequence: Synthetic oligonucleotide

SEQ ID NO: 11850 - DNA, 10 bp, Artificial Sequence
  Description of Artificial Sequence: Synthetic oligonucleotide
cgataacgcg

SEQ ID NO: 11851 - DNA, 26 bp, Artificial Sequence
  Description of Artificial Sequence: Synthetic oligonucleotide
cgcggtcgtttggtcgaatttgttcg

SEQ ID NO: 11852 - DNA, 934 bp, Artificial Sequence; identical to SEQ ID NO: 9500
  Description of Artificial Sequence: Synthetic polynucleotide

SEQ ID NO: 11853 - DNA, 279 bp, Artificial Sequence; identical to SEQ ID NO: 9501
  Description of Artificial Sequence: Synthetic polynucleotide

SEQ ID NO: 11854 - DNA, 2 bp, Artificial Sequence
  Description of Artificial Sequence: Synthetic oligonucleotide
cg

SEQ ID NO: 11855 - DNA, 9 bp, Artificial Sequence
  Description of Artificial Sequence: Synthetic oligonucleotide
cgcggggcg

SEQ ID NO: 11856 - DNA, 11 bp, Artificial Sequence
  Description of Artificial Sequence: Synthetic oligonucleotide
cgatgcgttcg

SEQ ID NO: 11857 - DNA, 30 bp, Artificial Sequence; identical to SEQ ID NO: 9505
  Description of Artificial Sequence: Synthetic oligonucleotide

SEQ ID NO: 11858 - DNA, 10 bp, Artificial Sequence
  Description of Artificial Sequence: Synthetic oligonucleotide
cgcgggagcg

SEQ ID NO: 11859 - DNA, 56 bp, Artificial Sequence; identical to SEQ ID NO: 9507
  Description of Artificial Sequence: Synthetic oligonucleotide

SEQ ID NO: 11860 - DNA, 98 bp, Artificial Sequence; identical to SEQ ID NO: 9508
  Description of Artificial Sequence: Synthetic oligonucleotide

SEQ ID NO: 11861 - DNA, 33 bp, Artificial Sequence; identical to SEQ ID NO: 9509
  Description of Artificial Sequence: Synthetic oligonucleotide

SEQ ID NO: 11862 - DNA, 48 bp, Artificial Sequence; identical to SEQ ID NO: 8766
  Description of Artificial Sequence: Synthetic oligonucleotide

SEQ ID NO: 11863 - DNA, 42 bp, Artificial Sequence; identical to SEQ ID NO: 9519
  Description of Artificial Sequence: Synthetic oligonucleotide

SEQ ID NO: 11864 - DNA, 40 bp, Artificial Sequence; identical to SEQ ID NO: 9530
  Description of Artificial Sequence: Synthetic oligonucleotide

SEQ ID NO: 11865 - DNA, 2 bp, Artificial Sequence
  Description of Artificial Sequence: Synthetic oligonucleotide
cg

SEQ ID NO: 11866 - DNA, 42 bp, Artificial Sequence; identical to SEQ ID NO: 9552
  Description of Artificial Sequence: Synthetic oligonucleotide

SEQ ID NO: 11867 - DNA, 219 bp, Homo sapiens; identical to SEQ ID NO: 9563

SEQ ID NO: 11868 - DNA, 315 bp, Homo sapiens; identical to SEQ ID NO: 9564

SEQ ID NO: 11869 - DNA, 243 bp, Homo sapiens; identical to SEQ ID NO: 9575

SEQ ID NO: 11870 - DNA, 233 bp, Homo sapiens; identical to SEQ ID NO: 9586

SEQ ID NO: 11871 - DNA, 410 bp, Homo sapiens; identical to SEQ ID NO: 9597

SEQ ID NO: 11872 - DNA, 294 bp, Homo sapiens; identical to SEQ ID NO: 9608

SEQ ID NO: 11873 - DNA, 463 bp, Homo sapiens; identical to SEQ ID NO: 9619

SEQ ID NO: 11874 - DNA, 258 bp, Homo sapiens; identical to SEQ ID NO: 9630

SEQ ID NO: 11875 - DNA, 203 bp, Homo sapiens; identical to SEQ ID NO: 9641

SEQ ID NO: 11876 - DNA, 523 bp, Homo sapiens; identical to SEQ ID NO: 9652

SEQ ID NO: 11877 - DNA, 301 bp, Homo sapiens; identical to SEQ ID NO: 9660

SEQ ID NO: 11878 - DNA, 223 bp, Homo sapiens; identical to SEQ ID NO: 9661

SEQ ID NO: 11879 - DNA, 720 bp, Homo sapiens; identical to SEQ ID NO: 9662

SEQ ID NO: 11880 - DNA, 1683 bp, Homo sapiens; identical to SEQ ID NO: 9663

SEQ ID NO: 11881 - DNA, 233 bp, Homo sapiens; identical to SEQ ID NO: 9664

SEQ ID NO: 11882 - DNA, 213 bp, Homo sapiens; identical to SEQ ID NO: 9665

SEQ ID NO: 11883 - DNA, 236 bp, Homo sapiens; identical to SEQ ID NO: 9666

SEQ ID NO: 11884 - DNA, 233 bp, Homo sapiens; identical to SEQ ID NO: 9667

SEQ ID NO: 11885 - DNA, 737 bp, Homo sapiens; identical to SEQ ID NO: 9668

SEQ ID NO: 11886 - DNA, 308 bp, Homo sapiens; identical to SEQ ID NO: 9669

SEQ ID NO: 11887 - DNA, 1100 bp, Homo sapiens; identical to SEQ ID NO: 9670

SEQ ID NO: 11888 - DNA, 214 bp, Homo sapiens; identical to SEQ ID NO: 9671

SEQ ID NO: 11889 - DNA, 582 bp, Homo sapiens; identical to SEQ ID NO: 9672

SEQ ID NO: 11890 - DNA, 203 bp, Homo sapiens; identical to SEQ ID NO: 9673

SEQ ID NO: 11891 - DNA, 823 bp, Homo sapiens; identical to SEQ ID NO: 9674

SEQ ID NO: 11892 - DNA, 293 bp, Homo sapiens; identical to SEQ ID NO: 9675

SEQ ID NO: 11893 - DNA, 262 bp, Homo sapiens; identical to SEQ ID NO: 9676

SEQ ID NO: 11894 - DNA, 240 bp, Homo sapiens; identical to SEQ ID NO: 9677

SEQ ID NO: 11895 - DNA, 1240 bp, Homo sapiens; identical to SEQ ID NO: 9678

SEQ ID NO: 11896 - DNA, 222 bp, Homo sapiens; identical to SEQ ID NO: 9679

SEQ ID NO: 11897 - DNA, 714 bp, Homo sapiens; identical to SEQ ID NO: 9680

SEQ ID NO: 11898 - DNA, 1216 bp, Homo sapiens; identical to SEQ ID NO: 9681

SEQ ID NO: 11899 - DNA, 207 bp, Homo sapiens; identical to SEQ ID NO: 9682

SEQ ID NO: 11900 - DNA, 253 bp, Homo sapiens; identical to SEQ ID NO: 9683

SEQ ID NO: 11901 - DNA, 209 bp, Homo sapiens; identical to SEQ ID NO: 9684

SEQ ID NO: 11902 - DNA, 225 bp, Homo sapiens; identical to SEQ ID NO: 9685

SEQ ID NO: 11903 - DNA, 1133 bp, Homo sapiens; identical to SEQ ID NO: 9686

SEQ ID NO: 11904 - DNA, 478 bp, Homo sapiens; identical to SEQ ID NO: 9687

SEQ ID NO: 11905 - DNA, 201 bp, Homo sapiens; identical to SEQ ID NO: 9688

SEQ ID NO: 11906 - DNA, 208 bp, Homo sapiens; identical to SEQ ID NO: 9689

SEQ ID NO: 11907 - DNA, 210 bp, Homo sapiens; identical to SEQ ID NO: 9690

SEQ ID NO: 11908 - DNA, 229 bp, Homo sapiens; identical to SEQ ID NO: 9691

SEQ ID NO: 11909 - DNA, 209 bp, Homo sapiens; identical to SEQ ID NO: 9692

SEQ ID NO: 11910 - DNA, 255 bp, Homo sapiens; identical to SEQ ID NO: 9693

SEQ ID NO: 11911 - DNA, 297 bp, Homo sapiens; identical to SEQ ID NO: 9694

SEQ ID NO: 11912 - DNA, 232 bp, Homo sapiens; identical to SEQ ID NO: 9695

SEQ ID NO: 11913 - DNA, 247 bp, Homo sapiens; identical to SEQ ID NO: 9696

SEQ ID NO: 11914 - DNA, 241 bp, Homo sapiens; identical to SEQ ID NO: 9705

SEQ ID NO: 11915 - DNA, 239 bp, Homo sapiens; identical to SEQ ID NO: 9716

SEQ ID NO: 11916 - DNA, 201 bp, Homo sapiens; identical to SEQ ID NO: 9727

SEQ ID NO: 11917 - DNA, 241 bp, Homo sapiens; identical to SEQ ID NO: 9738

SEQ ID NO: 11918 - DNA, 219 bp, Homo sapiens; identical to SEQ ID NO: 9749

SEQ ID NO: 11919 - DNA, 315 bp, Homo sapiens; identical to SEQ ID NO: 9750

SEQ ID NO: 11920 - DNA, 243 bp, Homo sapiens; identical to SEQ ID NO: 9761

SEQ ID NO: 11921 - DNA, 233 bp, Homo sapiens; identical to SEQ ID NO: 9772

SEQ ID NO: 11922 - DNA, 410 bp, Homo sapiens; identical to SEQ ID NO: 9783

SEQ ID NO: 11923 - DNA, 294 bp, Homo sapiens; identical to SEQ ID NO: 9794

SEQ ID NO: 11924 - DNA, 463 bp, Homo sapiens; identical to SEQ ID NO: 9805

SEQ ID NO: 11925 - DNA, 258 bp, Homo sapiens; identical to SEQ ID NO: 9816

SEQ ID NO: 11926 - DNA, 203 bp, Homo sapiens; identical to SEQ ID NO: 9827

SEQ ID NO: 11927 - DNA, 523 bp, Homo sapiens; identical to SEQ ID NO: 9838

SEQ ID NO: 11928 - DNA, 301 bp, Homo sapiens; identical to SEQ ID NO: 9846

SEQ ID NO: 11929 - DNA, 223 bp, Homo sapiens; identical to SEQ ID NO: 9847

SEQ ID NO: 11930 - DNA, 720 bp, Homo sapiens; identical to SEQ ID NO: 9848

SEQ ID NO: 11931 - DNA, 1683 bp, Homo sapiens; identical to SEQ ID NO: 9849

SEQ ID NO: 11932 - DNA, 233 bp, Homo sapiens; identical to SEQ ID NO: 9850

SEQ ID NO: 11933 - DNA, 213 bp, Homo sapiens; identical to SEQ ID NO: 9851

SEQ ID NO: 11934 - DNA, 236 bp, Homo sapiens; identical to SEQ ID NO: 9852

SEQ ID NO: 11935 - DNA, 233 bp, Homo sapiens; identical to SEQ ID NO: 9853

SEQ ID NO: 11936 - DNA, 737 bp, Homo sapiens; identical to SEQ ID NO: 9854

SEQ ID NO: 11937 - DNA, 308 bp, Homo sapiens; identical to SEQ ID NO: 9855

SEQ ID NO: 11938 - DNA, 1100 bp, Homo sapiens; identical to SEQ ID NO: 9856

SEQ ID NO: 11939 - DNA, 214 bp, Homo sapiens; identical to SEQ ID NO: 9857

SEQ ID NO: 11940 - DNA, 582 bp, Homo sapiens; identical to SEQ ID NO: 9858

SEQ ID NO: 11941 - DNA, 203 bp, Homo sapiens; identical to SEQ ID NO: 9859

SEQ ID NO: 11942 - DNA, 823 bp, Homo sapiens; identical to SEQ ID NO: 9860

SEQ ID NO: 11943 - DNA, 293 bp, Homo sapiens; identical to SEQ ID NO: 9861

SEQ ID NO: 11944 - DNA, 262 bp, Homo sapiens; identical to SEQ ID NO: 9862

SEQ ID NO: 11945 - DNA, 240 bp, Homo sapiens; identical to SEQ ID NO: 9863

SEQ ID NO: 11946 - DNA, 1240 bp, Homo sapiens; identical to SEQ ID NO: 9864

SEQ ID NO: 11947 - DNA, 222 bp, Homo sapiens; identical to SEQ ID NO: 9865

SEQ ID NO: 11948 - DNA, 714 bp, Homo sapiens; identical to SEQ ID NO: 9866

SEQ ID NO: 11949 - DNA, 1216 bp, Homo sapiens; identical to SEQ ID NO: 9867

SEQ ID NO: 11950 - DNA, 207 bp, Homo sapiens; identical to SEQ ID NO: 9868

SEQ ID NO: 11951 - DNA, 253 bp, Homo sapiens; identical to SEQ ID NO: 9869

SEQ ID NO: 11952 - DNA, 209 bp, Homo sapiens; identical to SEQ ID NO: 9870

SEQ ID NO: 11953 - DNA, 225 bp, Homo sapiens; identical to SEQ ID NO: 9871

SEQ ID NO: 11954 - DNA, 1133 bp, Homo sapiens; identical to SEQ ID NO: 9872

SEQ ID NO: 11955 - DNA, 478 bp, Homo sapiens; identical to SEQ ID NO: 9873

SEQ ID NO: 11956 - DNA, 201 bp, Homo sapiens; identical to SEQ ID NO: 9874

SEQ ID NO: 11957 - DNA, 208 bp, Homo sapiens; identical to SEQ ID NO: 9875

SEQ ID NO: 11958 - DNA, 210 bp, Homo sapiens; identical to SEQ ID NO: 9876

SEQ ID NO: 11959 - DNA, 229 bp, Homo sapiens; identical to SEQ ID NO: 9877

SEQ ID NO: 11960 - DNA, 209 bp, Homo sapiens; identical to SEQ ID NO: 9878

SEQ ID NO: 11961 - DNA, 255 bp, Homo sapiens; identical to SEQ ID NO: 9879

SEQ ID NO: 11962 - DNA, 297 bp, Homo sapiens; identical to SEQ ID NO: 9880

SEQ ID NO: 11963 - DNA, 232 bp, Homo sapiens; identical to SEQ ID NO: 9881

SEQ ID NO: 11964 - DNA, 247 bp, Homo sapiens; identical to SEQ ID NO: 9882

SEQ ID NO: 11965 - DNA, 241 bp, Homo sapiens; identical to SEQ ID NO: 9891

SEQ ID NO: 11966 - DNA, 239 bp, Homo sapiens; identical to SEQ ID NO: 9902

SEQ ID NO: 11967 - DNA, 201 bp, Homo sapiens; identical to SEQ ID NO: 9913

SEQ ID NO: 11968 - DNA, 241 bp, Homo sapiens; identical to SEQ ID NO: 9924

SEQ ID NO: 11969 - DNA, 219 bp, Artificial Sequence; identical to SEQ ID NO: 9935
  Description of Artificial Sequence: Synthetic polynucleotide

SEQ ID NO: 11970 - DNA, 315 bp, Artificial Sequence; identical to SEQ ID NO: 9936
  Description of Artificial Sequence: Synthetic polynucleotide

SEQ ID NO: 11971 - DNA, 243 bp, Artificial Sequence; identical to SEQ ID NO: 9947
  Description of Artificial Sequence: Synthetic polynucleotide

SEQ ID NO: 11972 - DNA, 233 bp, Artificial Sequence; identical to SEQ ID NO: 9958
  Description of Artificial Sequence: Synthetic polynucleotide

SEQ ID NO: 11973 - DNA, 410 bp, Artificial Sequence; identical to SEQ ID NO: 9969
  Description of Artificial Sequence: Synthetic polynucleotide

SEQ ID NO: 11974 - DNA, 294 bp, Artificial Sequence; identical to SEQ ID NO: 9980
  Description of Artificial Sequence: Synthetic polynucleotide

SEQ ID NO: 11975 - DNA, 463 bp, Artificial Sequence; identical to SEQ ID NO: 9991
  Description of Artificial Sequence: Synthetic polynucleotide

SEQ ID NO: 11976 - DNA, 258 bp, Artificial Sequence; identical to SEQ ID NO: 10002
  Description of Artificial Sequence: Synthetic polynucleotide

SEQ ID NO: 11977 - DNA, 203 bp, Artificial Sequence; identical to SEQ ID NO: 10013
  Description of Artificial Sequence: Synthetic polynucleotide

SEQ ID NO: 11978 - DNA, 523 bp, Artificial Sequence; identical to SEQ ID NO: 10024
  Description of Artificial Sequence: Synthetic polynucleotide

SEQ ID NO: 11979 - DNA, 301 bp, Artificial Sequence; identical to SEQ ID NO: 10032
  Description of Artificial Sequence: Synthetic polynucleotide

SEQ ID NO: 11980 - DNA, 223 bp, Artificial Sequence; identical to SEQ ID NO: 10033
  Description of Artificial Sequence: Synthetic polynucleotide

SEQ ID NO: 11981 - DNA, 720 bp, Artificial Sequence; identical to SEQ ID NO: 10034
  Description of Artificial Sequence: Synthetic polynucleotide

SEQ ID NO: 11982 - DNA, 1683 bp, Artificial Sequence; identical to SEQ ID NO: 10035
  Description of Artificial Sequence: Synthetic polynucleotide

SEQ ID NO: 11983 - DNA, 233 bp, Artificial Sequence; identical to SEQ ID NO: 10036
  Description of Artificial Sequence: Synthetic polynucleotide

SEQ ID NO: 11984 - DNA, 213 bp, Artificial Sequence; identical to SEQ ID NO: 10037
  Description of Artificial Sequence: Synthetic polynucleotide

SEQ ID NO: 11985 - DNA, 236 bp, Artificial Sequence; identical to SEQ ID NO: 10038
  Description of Artificial Sequence: Synthetic polynucleotide

SEQ ID NO: 11986 - DNA, 233 bp, Artificial Sequence; identical to SEQ ID NO: 10039
  Description of Artificial Sequence: Synthetic polynucleotide

SEQ ID NO: 11987 - DNA, 737 bp, Artificial Sequence; identical to SEQ ID NO: 10040
  Description of Artificial Sequence: Synthetic polynucleotide

SEQ ID NO: 11988 - DNA, 308 bp, Artificial Sequence; identical to SEQ ID NO: 10041
  Description of Artificial Sequence: Synthetic polynucleotide

SEQ ID NO: 11989 - DNA, 1100 bp, Artificial Sequence; identical to SEQ ID NO: 10042
  Description of Artificial Sequence: Synthetic polynucleotide

SEQ ID NO: 11990 - DNA, 214 bp, Artificial Sequence; identical to SEQ ID NO: 10043
  Description of Artificial Sequence: Synthetic polynucleotide

SEQ ID NO: 11991 - DNA, 582 bp, Artificial Sequence; identical to SEQ ID NO: 10044
  Description of Artificial Sequence: Synthetic polynucleotide

SEQ ID NO: 11992 - DNA, 203 bp, Artificial Sequence; identical to SEQ ID NO: 10045
  Description of Artificial Sequence: Synthetic polynucleotide

SEQ ID NO: 11993 - DNA, 823 bp, Artificial Sequence; identical to SEQ ID NO: 10046
  Description of Artificial Sequence: Synthetic polynucleotide

SEQ ID NO: 11994 - DNA, 293 bp, Artificial Sequence; identical to SEQ ID NO: 10047
  Description of Artificial Sequence: Synthetic polynucleotide

SEQ ID NO: 11995 - DNA, 262 bp, Artificial Sequence; identical to SEQ ID NO: 10048
  Description of Artificial Sequence: Synthetic polynucleotide

SEQ ID NO: 11996 - DNA, 240 bp, Artificial Sequence; identical to SEQ ID NO: 10049
  Description of Artificial Sequence: Synthetic polynucleotide

SEQ ID NO: 11997 - DNA, 1240 bp, Artificial Sequence; identical to SEQ ID NO: 10050
  Description of Artificial Sequence: Synthetic polynucleotide

SEQ ID NO: 11998 - DNA, 222 bp, Artificial Sequence; identical to SEQ ID NO: 10051
  Description of Artificial Sequence: Synthetic polynucleotide

SEQ ID NO: 11999 - DNA, 714 bp, Artificial Sequence; identical to SEQ ID NO: 10052
  Description of Artificial Sequence: Synthetic polynucleotide

SEQ ID NO: 12000 - DNA, 1216 bp, Artificial Sequence; identical to SEQ ID NO: 10053
  Description of Artificial Sequence: Synthetic polynucleotide

SEQ ID NO: 12001 - DNA, 207 bp, Artificial Sequence; identical to SEQ ID NO: 10054
  Description of Artificial Sequence: Synthetic polynucleotide

SEQ ID NO: 12002 - DNA, 253 bp, Artificial Sequence; identical to SEQ ID NO: 10055
  Description of Artificial Sequence: Synthetic polynucleotide

SEQ ID NO: 12003 - DNA, 209 bp, Artificial Sequence; identical to SEQ ID NO: 10056
  Description of Artificial Sequence: Synthetic polynucleotide

SEQ ID NO: 12004 - DNA, 225 bp, Artificial Sequence; identical to SEQ ID NO: 10057
  Description of Artificial Sequence: Synthetic polynucleotide

SEQ ID NO: 12005 - DNA, 1133 bp, Artificial Sequence; identical to SEQ ID NO: 10058
  Description of Artificial Sequence: Synthetic polynucleotide

SEQ ID NO: 12006 - DNA, 478 bp, Artificial Sequence; identical to SEQ ID NO: 10059
  Description of Artificial Sequence: Synthetic polynucleotide

SEQ ID NO: 12007 - DNA, 201 bp, Artificial Sequence; identical to SEQ ID NO: 10060
  Description of Artificial Sequence: Synthetic polynucleotide

SEQ ID NO: 12008 - DNA, 208 bp, Artificial Sequence; identical to SEQ ID NO: 10061
  Description of Artificial Sequence: Synthetic polynucleotide

SEQ ID NO: 12009 - DNA, 210 bp, Artificial Sequence; identical to SEQ ID NO: 10062
  Description of Artificial Sequence: Synthetic polynucleotide

SEQ ID NO: 12010 - DNA, 229 bp, Artificial Sequence; identical to SEQ ID NO: 10063
  Description of Artificial Sequence: Synthetic polynucleotide

SEQ ID NO: 12011 - DNA, 209 bp, Artificial Sequence; identical to SEQ ID NO: 10064
  Description of Artificial Sequence: Synthetic polynucleotide

SEQ ID NO: 12012 - DNA, 255 bp, Artificial Sequence; identical to SEQ ID NO: 10065
  Description of Artificial Sequence: Synthetic polynucleotide

SEQ ID NO: 12013 - DNA, 297 bp, Artificial Sequence; identical to SEQ ID NO: 10066
  Description of Artificial Sequence: Synthetic polynucleotide

SEQ ID NO: 12014 - DNA, 232 bp, Artificial Sequence; identical to SEQ ID NO: 10067
  Description of Artificial Sequence: Synthetic polynucleotide

SEQ ID NO: 12015 - DNA, 247 bp, Artificial Sequence; identical to SEQ ID NO: 10068
  Description of Artificial Sequence: Synthetic polynucleotide

SEQ ID NO: 12016 - DNA, 241 bp, Artificial Sequence; identical to SEQ ID NO: 10077
  Description of Artificial Sequence: Synthetic polynucleotide

SEQ ID NO: 12017 - DNA, 239 bp, Artificial Sequence; identical to SEQ ID NO: 10088
  Description of Artificial Sequence: Synthetic polynucleotide

SEQ ID NO: 12018 - DNA, 201 bp, Artificial Sequence; identical to SEQ ID NO: 10099
  Description of Artificial Sequence: Synthetic polynucleotide

SEQ ID NO: 12019 - DNA, 241 bp, Artificial Sequence; identical to SEQ ID NO: 10110
  Description of Artificial Sequence: Synthetic polynucleotide

SEQ ID NO: 12020 - DNA, 219 bp, Artificial Sequence; identical to SEQ ID NO: 10121
  Description of Artificial Sequence: Synthetic polynucleotide

SEQ ID NO: 12021 - DNA, 315 bp, Artificial Sequence; identical to SEQ ID NO: 10122
  Description of Artificial Sequence: Synthetic polynucleotide

SEQ ID NO: 12022 - DNA, 243 bp, Artificial Sequence; identical to SEQ ID NO: 10133
  Description of Artificial Sequence: Synthetic polynucleotide

SEQ ID NO: 12023 - DNA, 233 bp, Artificial Sequence; identical to SEQ ID NO: 10144
  Description of Artificial Sequence: Synthetic polynucleotide

SEQ ID NO: 12024 - DNA, 410 bp, Artificial Sequence; identical to SEQ ID NO: 10155
  Description of Artificial Sequence: Synthetic polynucleotide

SEQ ID NO: 12025 - DNA, 294 bp, Artificial Sequence; identical to SEQ ID NO: 10166
  Description of Artificial Sequence: Synthetic polynucleotide

SEQ ID NO: 12026 - DNA, 463 bp, Artificial Sequence; identical to SEQ ID NO: 10177
  Description of Artificial Sequence: Synthetic polynucleotide

SEQ ID NO: 12027 - DNA, 258 bp, Artificial Sequence; identical to SEQ ID NO: 10188
  Description of Artificial Sequence: Synthetic polynucleotide

SEQ ID NO: 12028 - DNA, 203 bp, Artificial Sequence; identical to SEQ ID NO: 10199
  Description of Artificial Sequence: Synthetic polynucleotide

SEQ ID NO: 12029 - DNA, 523 bp, Artificial Sequence; identical to SEQ ID NO: 10210
  Description of Artificial Sequence: Synthetic polynucleotide

SEQ ID NO: 12030 - DNA, 301 bp, Artificial Sequence; identical to SEQ ID NO: 10218
  Description of Artificial Sequence: Synthetic polynucleotide

SEQ ID NO: 12031 - DNA, 223 bp, Artificial Sequence; identical to SEQ ID NO: 10219
  Description of Artificial Sequence: Synthetic polynucleotide

SEQ ID NO: 12032 - DNA, 720 bp, Artificial Sequence; identical to SEQ ID NO: 10220
  Description of Artificial Sequence: Synthetic polynucleotide

SEQ ID NO: 12033 - DNA, 1683 bp, Artificial Sequence; identical to SEQ ID NO: 10221
  Description of Artificial Sequence: Synthetic polynucleotide

SEQ ID NO: 12034 - DNA, 233 bp, Artificial Sequence; identical to SEQ ID NO: 10222
  Description of Artificial Sequence: Synthetic polynucleotide

SEQ ID NO: 12035 - DNA, 213 bp, Artificial Sequence; identical to SEQ ID NO: 10223
  Description of Artificial Sequence: Synthetic polynucleotide

SEQ ID NO: 12036 - DNA, 236 bp, Artificial Sequence; identical to SEQ ID NO: 10224
  Description of Artificial Sequence: Synthetic polynucleotide

SEQ ID NO: 12037 - DNA, 233 bp, Artificial Sequence; identical to SEQ ID NO: 10225
  Description of Artificial Sequence: Synthetic polynucleotide

SEQ ID NO: 12038 - DNA, 737 bp, Artificial Sequence; identical to SEQ ID NO: 10226
  Description of Artificial Sequence: Synthetic polynucleotide

SEQ ID NO: 12039 - DNA, 308 bp, Artificial Sequence; identical to SEQ ID NO: 10227
  Description of Artificial Sequence: Synthetic polynucleotide

SEQ ID NO: 12040 - DNA, 1100 bp, Artificial Sequence; identical to SEQ ID NO: 10228
  Description of Artificial Sequence: Synthetic polynucleotide

SEQ ID NO: 12041 - DNA, 214 bp, Artificial Sequence; identical to SEQ ID NO: 10229
  Description of Artificial Sequence: Synthetic polynucleotide

SEQ ID NO: 12042 - DNA, 582 bp, Artificial Sequence; identical to SEQ ID NO: 10230
  Description of Artificial Sequence: Synthetic polynucleotide

SEQ ID NO: 12043 - DNA, 203 bp, Artificial Sequence; identical to SEQ ID NO: 10231
  Description of Artificial Sequence: Synthetic polynucleotide

SEQ ID NO: 12044 - DNA, 823 bp, Artificial Sequence; identical to SEQ ID NO: 10232
  Description of Artificial Sequence: Synthetic polynucleotide

SEQ ID NO: 12045 - DNA, 293 bp, Artificial Sequence; identical to SEQ ID NO: 10233
  Description of Artificial Sequence: Synthetic polynucleotide

SEQ ID NO: 12046 - DNA, 262 bp, Artificial Sequence; identical to SEQ ID NO: 10234
  Description of Artificial Sequence: Synthetic polynucleotide

SEQ ID NO: 12047 - DNA, 240 bp, Artificial Sequence; identical to SEQ ID NO: 10235
  Description of Artificial Sequence: Synthetic polynucleotide

SEQ ID NO: 12048 - DNA, 1240 bp, Artificial Sequence; identical to SEQ ID NO: 10236
  Description of Artificial Sequence: Synthetic polynucleotide

SEQ ID NO: 12049 - DNA, 222 bp, Artificial Sequence; identical to SEQ ID NO: 10237
  Description of Artificial Sequence: Synthetic polynucleotide

SEQ ID NO: 12050 - DNA, 714 bp, Artificial Sequence; identical to SEQ ID NO: 10238
  Description of Artificial Sequence: Synthetic polynucleotide

SEQ ID NO: 12051 - DNA, 1216 bp, Artificial Sequence; identical to SEQ ID NO: 10239
  Description of Artificial Sequence: Synthetic polynucleotide

SEQ ID NO: 12052 - DNA, 207 bp, Artificial Sequence; identical to SEQ ID NO: 10240
  Description of Artificial Sequence: Synthetic polynucleotide

SEQ ID NO: 12053 - DNA, 253 bp, Artificial Sequence; identical to SEQ ID NO: 10241
  Description of Artificial Sequence: Synthetic polynucleotide

SEQ ID NO: 12054 - DNA, 209 bp, Artificial Sequence; identical to SEQ ID NO: 10242
  Description of Artificial Sequence: Synthetic polynucleotide

SEQ ID NO: 12055 - DNA, 225 bp, Artificial Sequence; identical to SEQ ID NO: 10243
  Description of Artificial Sequence: Synthetic polynucleotide

SEQ ID NO: 12056 - DNA, 1133 bp, Artificial Sequence; identical to SEQ ID NO: 10244
  Description of Artificial Sequence: Synthetic polynucleotide

SEQ ID NO: 12057 - DNA, 478 bp, Artificial Sequence; identical to SEQ ID NO: 10245
  Description of Artificial Sequence: Synthetic polynucleotide

SEQ ID NO: 12058 - DNA, 201 bp, Artificial Sequence; identical to SEQ ID NO: 10246
  Description of Artificial Sequence: Synthetic polynucleotide

SEQ ID NO: 12059 - DNA, 208 bp, Artificial Sequence; identical to SEQ ID NO: 10247
  Description of Artificial Sequence: Synthetic polynucleotide

SEQ ID NO: 12060 - DNA, 210 bp, Artificial Sequence; identical to SEQ ID NO: 10248
  Description of Artificial Sequence: Synthetic polynucleotide

SEQ ID NO: 12061 - DNA, 229 bp, Artificial Sequence; identical to SEQ ID NO: 10249
  Description of Artificial Sequence: Synthetic polynucleotide

SEQ ID NO: 12062 - DNA, 209 bp, Artificial Sequence; identical to SEQ ID NO: 10250
  Description of Artificial Sequence: Synthetic polynucleotide

SEQ ID NO: 12063 - DNA, 255 bp, Artificial Sequence; identical to SEQ ID NO: 10251
  Description of Artificial Sequence: Synthetic polynucleotide

SEQ ID NO: 12064 - DNA, 297 bp, Artificial Sequence; identical to SEQ ID NO: 10252
  Description of Artificial Sequence: Synthetic polynucleotide

SEQ ID NO: 12065 - DNA, 232 bp, Artificial Sequence; identical to SEQ ID NO: 10253
  Description of Artificial Sequence: Synthetic polynucleotide

SEQ ID NO: 12066 - DNA, 247 bp, Artificial Sequence; identical to SEQ ID NO: 10254
  Description of Artificial Sequence: Synthetic polynucleotide

SEQ ID NO: 12067 - DNA, 241 bp, Artificial Sequence; identical to SEQ ID NO: 10263
  Description of Artificial Sequence: Synthetic polynucleotide

SEQ ID NO: 12068 - DNA, 239 bp, Artificial Sequence; identical to SEQ ID NO: 10274
  Description of Artificial Sequence: Synthetic polynucleotide

SEQ ID NO: 12069 - DNA, 201 bp, Artificial Sequence; identical to SEQ ID NO: 10285
  Description of Artificial Sequence: Synthetic polynucleotide

SEQ ID NO: 12070 - DNA, 241 bp, Artificial Sequence; identical to SEQ ID NO: 10296
  Description of Artificial Sequence: Synthetic polynucleotide

SEQ ID NO: 12071 - DNA, 219 bp, Artificial Sequence; identical to SEQ ID NO: 10307
  Description of Artificial Sequence: Synthetic polynucleotide

SEQ ID NO: 12072 - DNA, 315 bp, Artificial Sequence; identical to SEQ ID NO: 10308
  Description of Artificial Sequence: Synthetic polynucleotide

SEQ ID NO: 12073 - DNA, 243 bp, Artificial Sequence; identical to SEQ ID NO: 10319
  Description of Artificial Sequence: Synthetic polynucleotide

SEQ ID NO: 12074 - DNA, 233 bp, Artificial Sequence; identical to SEQ ID NO: 10330
  Description of Artificial Sequence: Synthetic polynucleotide

SEQ ID NO: 12075 - DNA, 410 bp, Artificial Sequence; identical to SEQ ID NO: 10341
  Description of Artificial Sequence: Synthetic polynucleotide

SEQ ID NO: 12076 - DNA, 294 bp, Artificial Sequence; identical to SEQ ID NO: 10352
  Description of Artificial Sequence: Synthetic polynucleotide

SEQ ID NO: 12077 - DNA, 463 bp, Artificial Sequence; identical to SEQ ID NO: 10363
  Description of Artificial Sequence: Synthetic polynucleotide

SEQ ID NO: 12078 - DNA, 258 bp, Artificial Sequence; identical to SEQ ID NO: 10374
  Description of Artificial Sequence: Synthetic polynucleotide

SEQ ID NO: 12079 - DNA, 203 bp, Artificial Sequence; identical to SEQ ID NO: 10385
  Description of Artificial Sequence: Synthetic polynucleotide

SEQ ID NO: 12080 - DNA, 523 bp, Artificial Sequence; identical to SEQ ID NO: 10396
  Description of Artificial Sequence: Synthetic polynucleotide

SEQ ID NO: 12081 - DNA, 301 bp, Artificial Sequence; identical to SEQ ID NO: 10404
  Description of Artificial Sequence: Synthetic polynucleotide

SEQ ID NO: 12082 - DNA, 223 bp, Artificial Sequence; identical to SEQ ID NO: 10405
  Description of Artificial Sequence: Synthetic polynucleotide

SEQ ID NO: 12083 - DNA, 720 bp, Artificial Sequence; identical to SEQ ID NO: 10406
  Description of Artificial Sequence: Synthetic polynucleotide

SEQ ID NO: 12084 - DNA, 1683 bp, Artificial Sequence; identical to SEQ ID NO: 10407
  Description of Artificial Sequence: Synthetic polynucleotide

SEQ ID NO: 12085 - DNA, 233 bp, Artificial Sequence; identical to SEQ ID NO: 10408
  Description of Artificial Sequence: Synthetic polynucleotide

SEQ ID NO: 12086 - DNA, 213 bp, Artificial Sequence; identical to SEQ ID NO: 10409
  Description of Artificial Sequence: Synthetic polynucleotide

SEQ ID NO: 12087 - DNA, 236 bp, Artificial Sequence; identical to SEQ ID NO: 10410
  Description of Artificial Sequence: Synthetic polynucleotide

SEQ ID NO: 12088 - DNA, 233 bp, Artificial Sequence; identical to SEQ ID NO: 10411
  Description of Artificial Sequence: Synthetic polynucleotide

SEQ ID NO: 12089 - DNA, 737 bp, Artificial Sequence; identical to SEQ ID NO: 10412
  Description of Artificial Sequence: Synthetic polynucleotide

SEQ ID NO: 12090 - DNA, 308 bp, Artificial Sequence; identical to SEQ ID NO: 10413
  Description of Artificial Sequence: Synthetic polynucleotide

SEQ ID NO: 12091 - DNA, 1100 bp, Artificial Sequence; identical to SEQ ID NO: 10414
  Description of Artificial Sequence: Synthetic polynucleotide

SEQ ID NO: 12092 - DNA, 214 bp, Artificial Sequence; identical to SEQ ID NO: 10415
  Description of Artificial Sequence: Synthetic polynucleotide

SEQ ID NO: 12093 - DNA, 582 bp, Artificial Sequence; identical to SEQ ID NO: 10416
  Description of Artificial Sequence: Synthetic polynucleotide

SEQ ID NO: 12094 - DNA, 203 bp, Artificial Sequence; identical to SEQ ID NO: 10417
  Description of Artificial Sequence: Synthetic polynucleotide

SEQ ID NO: 12095 - DNA, 823 bp, Artificial Sequence; identical to SEQ ID NO: 10418
  Description of Artificial Sequence: Synthetic polynucleotide

SEQ ID NO: 12096 - DNA, 293 bp, Artificial Sequence; identical to SEQ ID NO: 10419
  Description of Artificial Sequence: Synthetic polynucleotide

SEQ ID NO: 12097 - DNA, 262 bp, Artificial Sequence; identical to SEQ ID NO: 10420
  Description of Artificial Sequence: Synthetic polynucleotide

SEQ ID NO: 12098 - DNA, 240 bp, Artificial Sequence; identical to SEQ ID NO: 10421
  Description of Artificial Sequence: Synthetic polynucleotide

SEQ ID NO: 12099 - DNA, 1240 bp, Artificial Sequence; identical to SEQ ID NO: 10422
  Description of Artificial Sequence: Synthetic polynucleotide

SEQ ID NO: 12100 - DNA, 222 bp, Artificial Sequence; identical to SEQ ID NO: 10423
  Description of Artificial Sequence: Synthetic polynucleotide

SEQ ID NO: 12101 - DNA, 714 bp, Artificial Sequence; identical to SEQ ID NO: 10424
  Description of Artificial Sequence: Synthetic polynucleotide

SEQ ID NO: 12102 - DNA, 1216 bp, Artificial Sequence; identical to SEQ ID NO: 10425
  Description of Artificial Sequence: Synthetic polynucleotide

SEQ ID NO: 12103 - DNA, 207 bp, Artificial Sequence; identical to SEQ ID NO: 10426
  Description of Artificial Sequence: Synthetic polynucleotide

SEQ ID NO: 12104 - DNA, 253 bp, Artificial Sequence; identical to SEQ ID NO: 10427
  Description of Artificial Sequence: Synthetic polynucleotide

SEQ ID NO: 12105 - DNA, 209 bp, Artificial Sequence; identical to SEQ ID NO: 10428
  Description of Artificial Sequence: Synthetic polynucleotide

SEQ ID NO: 12106 - DNA, 225 bp, Artificial Sequence; identical to SEQ ID NO: 10429
  Description of Artificial Sequence: Synthetic polynucleotide

SEQ ID NO: 12107 - DNA, 1133 bp, Artificial Sequence; identical to SEQ ID NO: 10430
  Description of Artificial Sequence: Synthetic polynucleotide

SEQ ID NO: 12108 - DNA, 478 bp, Artificial Sequence; identical to SEQ ID NO: 10431
  Description of Artificial Sequence: Synthetic polynucleotide

SEQ ID NO: 12109 - DNA, 201 bp, Artificial Sequence; identical to SEQ ID NO: 10432
  Description of Artificial Sequence: Synthetic polynucleotide

SEQ ID NO: 12110 - DNA, 208 bp, Artificial Sequence; identical to SEQ ID NO: 10433
  Description of Artificial Sequence: Synthetic polynucleotide

SEQ ID NO: 12111 - DNA, 210 bp, Artificial Sequence; identical to SEQ ID NO: 10434
  Description of Artificial Sequence: Synthetic polynucleotide

SEQ ID NO: 12112 - DNA, 229 bp, Artificial Sequence; identical to SEQ ID NO: 10435
  Description of Artificial Sequence: Synthetic polynucleotide

SEQ ID NO: 12113 - DNA, 209 bp, Artificial Sequence; identical to SEQ ID NO: 10436
  Description of Artificial Sequence: Synthetic polynucleotide

SEQ ID NO: 12114 - DNA, 255 bp, Artificial Sequence; identical to SEQ ID NO: 10437
  Description of Artificial Sequence: Synthetic polynucleotide

SEQ ID NO: 12115 - DNA, 297 bp, Artificial Sequence; identical to SEQ ID NO: 10438
  Description of Artificial Sequence: Synthetic polynucleotide

SEQ ID NO: 12116 - DNA, 232 bp, Artificial Sequence; identical to SEQ ID NO: 10439
  Description of Artificial Sequence: Synthetic polynucleotide

SEQ ID NO: 12117 - DNA, 247 bp, Artificial Sequence; identical to SEQ ID NO: 10440
  Description of Artificial Sequence: Synthetic polynucleotide

SEQ ID NO: 12118 - DNA, 241 bp, Artificial Sequence; identical to SEQ ID NO: 10449
  Description of Artificial Sequence: Synthetic polynucleotide

SEQ ID NO: 12119 - DNA, 239 bp, Artificial Sequence; identical to SEQ ID NO: 10460
  Description of Artificial Sequence: Synthetic polynucleotide

SEQ ID NO: 12120 - DNA, 201 bp, Artificial Sequence; identical to SEQ ID NO: 10471
  Description of Artificial Sequence: Synthetic polynucleotide

SEQ ID NO: 12121 - DNA, 241 bp, Artificial Sequence; identical to SEQ ID NO: 10482
  Description of Artificial Sequence: Synthetic polynucleotide

SEQ ID NO: 12122 - DNA, 219 bp, Artificial Sequence; identical to SEQ ID NO: 10493
  Description of Artificial Sequence: Synthetic polynucleotide

SEQ ID NO: 12123 - DNA, 315 bp, Artificial Sequence; identical to SEQ ID NO: 10494
  Description of Artificial Sequence: Synthetic polynucleotide

SEQ ID NO: 12124 - DNA, 243 bp, Artificial Sequence; identical to SEQ ID NO: 10505
  Description of Artificial Sequence: Synthetic polynucleotide

SEQ ID NO: 12125 - DNA, 233 bp, Artificial Sequence; identical to SEQ ID NO: 10516
  Description of Artificial Sequence: Synthetic polynucleotide

SEQ ID NO: 12126 - DNA, 410 bp, Artificial Sequence; identical to SEQ ID NO: 10527
  Description of Artificial Sequence: Synthetic polynucleotide

SEQ ID NO: 12127 - DNA, 294 bp, Artificial Sequence; identical to SEQ ID NO: 10538
  Description of Artificial Sequence: Synthetic polynucleotide

SEQ ID NO: 12128 - DNA, 463 bp, Artificial Sequence; identical to SEQ ID NO: 10549
  Description of Artificial Sequence: Synthetic polynucleotide

SEQ ID NO: 12129 - DNA, 258 bp, Artificial Sequence; identical to SEQ ID NO: 10560
  Description of Artificial Sequence: Synthetic polynucleotide

SEQ ID NO: 12130 - DNA, 203 bp, Artificial Sequence; identical to SEQ ID NO: 10571
  Description of Artificial Sequence: Synthetic polynucleotide

SEQ ID NO: 12131 - DNA, 523 bp, Artificial Sequence; identical to SEQ ID NO: 10582
  Description of Artificial Sequence: Synthetic polynucleotide

SEQ ID NO: 12132 - DNA, 301 bp, Artificial Sequence; identical to SEQ ID NO: 10590
  Description of Artificial Sequence: Synthetic polynucleotide

SEQ ID NO: 12133 - DNA, 223 bp, Artificial Sequence; identical to SEQ ID NO: 10591
  Description of Artificial Sequence: Synthetic polynucleotide

SEQ ID NO: 12134 - DNA, 720 bp, Artificial Sequence; identical to SEQ ID NO: 10592
  Description of Artificial Sequence: Synthetic polynucleotide

SEQ ID NO: 12135 - DNA, 1683 bp, Artificial Sequence; identical to SEQ ID NO: 10593
  Description of Artificial Sequence: Synthetic polynucleotide

SEQ ID NO: 12136 - DNA, 233 bp, Artificial Sequence; identical to SEQ ID NO: 10594
  Description of Artificial Sequence: Synthetic polynucleotide

SEQ ID NO: 12137 - DNA, 213 bp, Artificial Sequence; identical to SEQ ID NO: 10595
  Description of Artificial Sequence: Synthetic polynucleotide

SEQ ID NO: 12138 - DNA, 236 bp, Artificial Sequence; identical to SEQ ID NO: 10596
  Description of Artificial Sequence: Synthetic polynucleotide

SEQ ID NO: 12139 - DNA, 233 bp, Artificial Sequence; identical to SEQ ID NO: 10597
  Description of Artificial Sequence: Synthetic polynucleotide

SEQ ID NO: 12140 - DNA, 737 bp, Artificial Sequence; identical to SEQ ID NO: 10598
  Description of Artificial Sequence: Synthetic polynucleotide

SEQ ID NO: 12141 - DNA, 308 bp, Artificial Sequence; identical to SEQ ID NO: 10599
  Description of Artificial Sequence: Synthetic polynucleotide

SEQ ID NO: 12142 - DNA, 1100 bp, Artificial Sequence; identical to SEQ ID NO: 10600
  Description of Artificial Sequence: Synthetic polynucleotide

SEQ ID NO: 12143 - DNA, 214 bp, Artificial Sequence; identical to SEQ ID NO: 10601
  Description of Artificial Sequence: Synthetic polynucleotide

SEQ ID NO: 12144 - DNA, 582 bp, Artificial Sequence; identical to SEQ ID NO: 10602
  Description of Artificial Sequence: Synthetic polynucleotide

SEQ ID NO: 12145 - DNA, 203 bp, Artificial Sequence; identical to SEQ ID NO: 10603
  Description of Artificial Sequence: Synthetic polynucleotide

SEQ ID NO: 12146 - DNA, 823 bp, Artificial Sequence; identical to SEQ ID NO: 10604
  Description of Artificial Sequence: Synthetic polynucleotide

SEQ ID NO: 12147 - DNA, 293 bp, Artificial Sequence; identical to SEQ ID NO: 10605
  Description of Artificial Sequence: Synthetic polynucleotide

SEQ ID NO: 12148 - DNA, 262 bp, Artificial Sequence; identical to SEQ ID NO: 10606
  Description of Artificial Sequence: Synthetic polynucleotide

SEQ ID NO: 12149 - DNA, 240 bp, Artificial Sequence; identical to SEQ ID NO: 10607
  Description of Artificial Sequence: Synthetic polynucleotide

SEQ ID NO: 12150 - DNA, 1240 bp, Artificial Sequence; identical to SEQ ID NO: 10608
  Description of Artificial Sequence: Synthetic polynucleotide

SEQ ID NO: 12151 - DNA, 222 bp, Artificial Sequence; identical to SEQ ID NO: 10609
  Description of Artificial Sequence: Synthetic polynucleotide

SEQ ID NO: 12152 - DNA, 714 bp, Artificial Sequence; identical to SEQ ID NO: 10610
  Description of Artificial Sequence: Synthetic polynucleotide

SEQ ID NO: 12153 - DNA, 1216 bp, Artificial Sequence; identical to SEQ ID NO: 10611
  Description of Artificial Sequence: Synthetic polynucleotide

SEQ ID NO: 12154 - DNA, 207 bp, Artificial Sequence; identical to SEQ ID NO: 10612
  Description of Artificial Sequence: Synthetic polynucleotide

SEQ ID NO: 12155 - DNA, 253 bp, Artificial Sequence; identical to SEQ ID NO: 10613
  Description of Artificial Sequence: Synthetic polynucleotide

SEQ ID NO: 12156 - DNA, 209 bp, Artificial Sequence; identical to SEQ ID NO: 10614
  Description of Artificial Sequence: Synthetic polynucleotide

SEQ ID NO: 12157 - DNA, 225 bp, Artificial Sequence; identical to SEQ ID NO: 10615
  Description of Artificial Sequence: Synthetic polynucleotide

SEQ ID NO: 12158 - DNA, 1133 bp, Artificial Sequence; identical to SEQ ID NO: 10616
  Description of Artificial Sequence: Synthetic polynucleotide

SEQ ID NO: 12159 - DNA, 478 bp, Artificial Sequence; identical to SEQ ID NO: 10617
  Description of Artificial Sequence: Synthetic polynucleotide

SEQ ID NO: 12160 - DNA, 201 bp, Artificial Sequence; identical to SEQ ID NO: 10618
  Description of Artificial Sequence: Synthetic polynucleotide

SEQ ID NO: 12161 - DNA, 208 bp, Artificial Sequence; identical to SEQ ID NO: 10619
  Description of Artificial Sequence: Synthetic polynucleotide

SEQ ID NO: 12162 - DNA, 210 bp, Artificial Sequence; identical to SEQ ID NO: 10620
  Description of Artificial Sequence: Synthetic polynucleotide

SEQ ID NO: 12163 - DNA, 229 bp, Artificial Sequence; identical to SEQ ID NO: 10621
  Description of Artificial Sequence: Synthetic polynucleotide

SEQ ID NO: 12164 - DNA, 209 bp, Artificial Sequence; identical to SEQ ID NO: 10622
  Description of Artificial Sequence: Synthetic polynucleotide

SEQ ID NO: 12165 - DNA, 255 bp, Artificial Sequence; identical to SEQ ID NO: 10623
  Description of Artificial Sequence: Synthetic polynucleotide

SEQ ID NO: 12166 - DNA, 297 bp, Artificial Sequence; identical to SEQ ID NO: 10624
  Description of Artificial Sequence: Synthetic polynucleotide

SEQ ID NO: 12167 - DNA, 232 bp, Artificial Sequence; identical to SEQ ID NO: 10625
  Description of Artificial Sequence: Synthetic polynucleotide

SEQ ID NO: 12168 - DNA, 247 bp, Artificial Sequence; identical to SEQ ID NO: 10626
  Description of Artificial Sequence: Synthetic polynucleotide

SEQ ID NO: 12169 - DNA, 241 bp, Artificial Sequence; identical to SEQ ID NO: 10635
  Description of Artificial Sequence: Synthetic polynucleotide

SEQ ID NO: 12170 - DNA, 239 bp, Artificial Sequence; identical to SEQ ID NO: 10646
  Description of Artificial Sequence: Synthetic polynucleotide

SEQ ID NO: 12171 - DNA, 201 bp, Artificial Sequence; identical to SEQ ID NO: 10657
  Description of Artificial Sequence: Synthetic polynucleotide

SEQ ID NO: 12172 - DNA, 241 bp, Artificial Sequence; identical to SEQ ID NO: 10668
  Description of Artificial Sequence: Synthetic polynucleotide

SEQ ID NO: 12173 - DNA, 848 bp, Homo sapiens; identical to SEQ ID NO: 10679

SEQ ID NO: 12174 - DNA, 1230 bp, Homo sapiens; identical to SEQ ID NO: 10680

SEQ ID NO: 12175 - DNA, 2172 bp, Homo sapiens; identical to SEQ ID NO: 10695

SEQ ID NO: 12176 - DNA, 338 bp, Homo sapiens; identical to SEQ ID NO: 10703

SEQ ID NO: 12177 - DNA, 5715 bp, Homo sapiens; identical to SEQ ID NO: 10711

SEQ ID NO: 12178 - DNA, 1059 bp, Homo sapiens; identical to SEQ ID NO: 10717

SEQ ID NO: 12179 - DNA, 1503 bp, Homo sapiens; identical to SEQ ID NO: 10725

SEQ ID NO: 12180 - DNA, 1437 bp, Homo sapiens; identical to SEQ ID NO: 10734

SEQ ID NO: 12181 - DNA, 1203 bp, Homo sapiens; identical to SEQ ID NO: 10743

SEQ ID NO: 12182 - DNA, 206 bp, Homo sapiens; identical to SEQ ID NO: 10749

SEQ ID NO: 12183 - DNA, 1141 bp, Homo sapiens; identical to SEQ ID NO: 10750

SEQ ID NO: 12184 - DNA, 1819 bp, Homo sapiens; identical to SEQ ID NO: 10751

SEQ ID NO: 12185 - DNA, 1813 bp, Homo sapiens; identical to SEQ ID NO: 10752

SEQ ID NO: 12186 - DNA, 1872 bp, Homo sapiens; identical to SEQ ID NO: 10753

SEQ ID NO: 12187 - DNA, 652 bp, Homo sapiens; identical to SEQ ID NO: 10754

SEQ ID NO: 12188 - DNA, 722 bp, Homo sapiens; identical to SEQ ID NO: 10755

SEQ ID NO: 12189 - DNA, 858 bp, Homo sapiens; identical to SEQ ID NO: 10756

SEQ ID NO: 12190 - DNA, 598 bp, Homo sapiens; identical to SEQ ID NO: 10757

SEQ ID NO: 12191 - DNA, 1281 bp, Homo sapiens; identical to SEQ ID NO: 10758

SEQ ID NO: 12192 - DNA, 1788 bp, Homo sapiens; identical to SEQ ID NO: 10759

SEQ ID NO: 12193 - DNA, 626 bp, Homo sapiens; identical to SEQ ID NO: 10760

SEQ ID NO: 12194 - DNA, 1037 bp, Homo sapiens; identical to SEQ ID NO: 10761

SEQ ID NO: 12195 - DNA, 977 bp, Homo sapiens; identical to SEQ ID NO: 10762

SEQ ID NO: 12196 - DNA, 6206 bp, Homo sapiens; identical to SEQ ID NO: 10763

SEQ ID NO: 12197 - DNA, 574 bp, Homo sapiens; identical to SEQ ID NO: 10764

SEQ ID NO: 12198 - DNA, 3438 bp, Homo sapiens; identical to SEQ ID NO: 10765

SEQ ID NO: 12199 - DNA, 4088 bp, Homo sapiens; identical to SEQ ID NO: 10766

SEQ ID NO: 12200 - DNA, 522 bp, Homo sapiens; identical to SEQ ID NO: 10767

SEQ ID NO: 12201 - DNA, 2260 bp, Homo sapiens; identical to SEQ ID NO: 10768

SEQ ID NO: 12202 - DNA, 1502 bp, Homo sapiens; identical to SEQ ID NO: 10769

SEQ ID NO: 12203 - DNA, 510 bp, Homo sapiens; identical to SEQ ID NO: 10770

SEQ ID NO: 12204 - DNA, 940 bp, Homo sapiens; identical to SEQ ID NO: 10771

SEQ ID NO: 12205 - DNA, 2718 bp, Homo sapiens; identical to SEQ ID NO: 10772

SEQ ID NO: 12206 - DNA, 2661 bp, Homo sapiens; identical to SEQ ID NO: 10773

SEQ ID NO: 12207 - DNA, 801 bp, Homo sapiens; identical to SEQ ID NO: 10774

SEQ ID NO: 12208 - DNA, 311 bp, Homo sapiens; identical to SEQ ID NO: 10775

SEQ ID NO: 12209 - DNA, 1048 bp, Homo sapiens; identical to SEQ ID NO: 10776

SEQ ID NO: 12210 - DNA, 301 bp, Homo sapiens; identical to SEQ ID NO: 10777

SEQ ID NO: 12211 - DNA, 1395 bp, Homo sapiens; identical to SEQ ID NO: 10778

SEQ ID NO: 12212 - DNA, 766 bp, Homo sapiens; identical to SEQ ID NO: 10779

SEQ ID NO: 12213 - DNA, 691 bp, Homo sapiens; identical to SEQ ID NO: 10780

SEQ ID NO: 12214 - DNA, 1024 bp, Homo sapiens; identical to SEQ ID NO: 10781

SEQ ID NO: 12215 - DNA, 1339 bp, Homo sapiens; identical to SEQ ID NO: 10782

SEQ ID NO: 12216 - DNA, 1376 bp, Homo sapiens; identical to SEQ ID NO: 10791

SEQ ID NO: 12217 - DNA, 3843 bp, Homo sapiens; identical to SEQ ID NO: 10798

SEQ ID NO: 12218 - DNA, 1622 bp, Homo sapiens; identical to SEQ ID NO: 10806

SEQ ID NO: 12219 - DNA, 1441 bp, Homo sapiens; identical to SEQ ID NO: 10817

SEQ ID NO: 12220 - DNA, 848 bp, Homo sapiens; identical to SEQ ID NO: 10826

SEQ ID NO: 12221 - DNA, 1230 bp, Homo sapiens; identical to SEQ ID NO: 10827

SEQ ID NO: 12222 - DNA, 2172 bp, Homo sapiens; identical to SEQ ID NO: 10842

SEQ ID NO: 12223 - DNA, 338 bp, Homo sapiens; identical to SEQ ID NO: 10850

SEQ ID NO: 12224 - DNA, 5715 bp, Homo sapiens; identical to SEQ ID NO: 10858

SEQ ID NO: 12225 - DNA, 1059 bp, Homo sapiens; identical to SEQ ID NO: 10864

SEQ ID NO: 12226 - DNA, 1503 bp, Homo sapiens; identical to SEQ ID NO: 10872

SEQ ID NO: 12227 - DNA, 1437 bp, Homo sapiens; identical to SEQ ID NO: 10881

SEQ ID NO: 12228 - DNA, 1203 bp, Homo sapiens; identical to SEQ ID NO: 10890

SEQ ID NO: 12229 - DNA, 206 bp, Homo sapiens; identical to SEQ ID NO: 10896

SEQ ID NO: 12230 - DNA, 1141 bp, Homo sapiens; identical to SEQ ID NO: 10897

SEQ ID NO: 12231 - DNA, 1819 bp, Homo sapiens; identical to SEQ ID NO: 10898

SEQ ID NO: 12232 - DNA, 1813 bp, Homo sapiens; identical to SEQ ID NO: 10899

SEQ ID NO: 12233 - DNA, 1872 bp, Homo sapiens; identical to SEQ ID NO: 10900

SEQ ID NO: 12234 - DNA, 652 bp, Homo sapiens; identical to SEQ ID NO: 10901

SEQ ID NO: 12235 - DNA, 722 bp, Homo sapiens; identical to SEQ ID NO: 10902

SEQ ID NO: 12236 - DNA, 858 bp, Homo sapiens; identical to SEQ ID NO: 10903

SEQ ID NO: 12237 - DNA, 598 bp, Homo sapiens; identical to SEQ ID NO: 10904

SEQ ID NO: 12238 - DNA, 1281 bp, Homo sapiens; identical to SEQ ID NO: 10905

SEQ ID NO: 12239 - DNA, 1788 bp, Homo sapiens; identical to SEQ ID NO: 10906

SEQ ID NO: 12240 - DNA, 626 bp, Homo sapiens; identical to SEQ ID NO: 10907

SEQ ID NO: 12241 - DNA, 1037 bp, Homo sapiens; identical to SEQ ID NO: 10908

SEQ ID NO: 12242 - DNA, 977 bp, Homo sapiens; identical to SEQ ID NO: 10909

SEQ ID NO: 12243 - DNA, 6206 bp, Homo sapiens; identical to SEQ ID NO: 10910

SEQ ID NO: 12244 - DNA, 574 bp, Homo sapiens; identical to SEQ ID NO: 10911

SEQ ID NO: 12245 - DNA, 3438 bp, Homo sapiens; identical to SEQ ID NO: 10912

SEQ ID NO: 12246 - DNA, 4088 bp, Homo sapiens; identical to SEQ ID NO: 10913

SEQ ID NO: 12247 - DNA, 522 bp, Homo sapiens; identical to SEQ ID NO: 10914

SEQ ID NO: 12248 - DNA, 2260 bp, Homo sapiens; identical to SEQ ID NO: 10915

SEQ ID NO: 12249 - DNA, 1502 bp, Homo sapiens; identical to SEQ ID NO: 10916

SEQ ID NO: 12250 - DNA, 510 bp, Homo sapiens; identical to SEQ ID NO: 10917

SEQ ID NO: 12251 - DNA, 940 bp, Homo sapiens; identical to SEQ ID NO: 10918

SEQ ID NO: 12252 - DNA, 2718 bp, Homo sapiens; identical to SEQ ID NO: 10919

SEQ ID NO: 12253 - DNA, 2661 bp, Homo sapiens; identical to SEQ ID NO: 10920

SEQ ID NO: 12254 - DNA, 801 bp, Homo sapiens; identical to SEQ ID NO: 10921

SEQ ID NO: 12255 - DNA, 311 bp, Homo sapiens; identical to SEQ ID NO: 10922

SEQ ID NO: 12256 - DNA, 1048 bp, Homo sapiens; identical to SEQ ID NO: 10923

SEQ ID NO: 12257 - DNA, 301 bp, Homo sapiens; identical to SEQ ID NO: 10924

SEQ ID NO: 12258 - DNA, 1395 bp, Homo sapiens; identical to SEQ ID NO: 10925

SEQ ID NO: 12259 - DNA, 766 bp, Homo sapiens; identical to SEQ ID NO: 10926

SEQ ID NO: 12260 - DNA, 691 bp, Homo sapiens; identical to SEQ ID NO: 10927

SEQ ID NO: 12261 - DNA, 1024 bp, Homo sapiens; identical to SEQ ID NO: 10928

SEQ ID NO: 12262 - DNA, 1339 bp, Homo sapiens; identical to SEQ ID NO: 10929

SEQ ID NO: 12263 - DNA, 1376 bp, Homo sapiens; identical to SEQ ID NO: 10938

SEQ ID NO: 12264 - DNA, 3843 bp, Homo sapiens; identical to SEQ ID NO: 10945

SEQ ID NO: 12265 - DNA, 1622 bp, Homo sapiens; identical to SEQ ID NO: 10953

SEQ ID NO: 12266 - DNA, 1441 bp, Homo sapiens; identical to SEQ ID NO: 10964

SEQ ID NO: 12267 - DNA, 848 bp, Artificial Sequence; identical to SEQ ID NO: 10973
  Description of Artificial Sequence: Synthetic polynucleotide

SEQ ID NO: 12268 - DNA, 1230 bp, Artificial Sequence; identical to SEQ ID NO: 10974
  Description of Artificial Sequence: Synthetic polynucleotide

SEQ ID NO: 12269 - DNA, 2172 bp, Artificial Sequence; identical to SEQ ID NO: 10989
  Description of Artificial Sequence: Synthetic polynucleotide

SEQ ID NO: 12270 - DNA, 338 bp, Artificial Sequence; identical to SEQ ID NO: 10997
  Description of Artificial Sequence: Synthetic polynucleotide

SEQ ID NO: 12271 - DNA, 5715 bp, Artificial Sequence; identical to SEQ ID NO: 11005
  Description of Artificial Sequence: Synthetic polynucleotide

SEQ ID NO: 12272 - DNA, 1059 bp, Artificial Sequence; identical to SEQ ID NO: 11011
  Description of Artificial Sequence: Synthetic polynucleotide

SEQ ID NO: 12273 - DNA, 1503 bp, Artificial Sequence; identical to SEQ ID NO: 11019
  Description of Artificial Sequence: Synthetic polynucleotide

SEQ ID NO: 12274 - DNA, 1437 bp, Artificial Sequence; identical to SEQ ID NO: 11028
  Description of Artificial Sequence: Synthetic polynucleotide

SEQ ID NO: 12275 - DNA, 1203 bp, Artificial Sequence; identical to SEQ ID NO: 11037
  Description of Artificial Sequence: Synthetic polynucleotide

SEQ ID NO: 12276 - DNA, 206 bp, Artificial Sequence; identical to SEQ ID NO: 11043
  Description of Artificial Sequence: Synthetic polynucleotide

SEQ ID NO: 12277 - DNA, 1141 bp, Artificial Sequence; identical to SEQ ID NO: 11044
  Description of Artificial Sequence: Synthetic polynucleotide

SEQ ID NO: 12278 - DNA, 1819 bp, Artificial Sequence; identical to SEQ ID NO: 11045
  Description of Artificial Sequence: Synthetic polynucleotide

SEQ ID NO: 12279 - DNA, 1813 bp, Artificial Sequence; identical to SEQ ID NO: 11046
  Description of Artificial Sequence: Synthetic polynucleotide

SEQ ID NO: 12280 - DNA, 1872 bp, Artificial Sequence; identical to SEQ ID NO: 11047
  Description of Artificial Sequence: Synthetic polynucleotide

SEQ ID NO: 12281 - DNA, 652 bp, Artificial Sequence; identical to SEQ ID NO: 11048
  Description of Artificial Sequence: Synthetic polynucleotide

SEQ ID NO: 12282 - DNA, 722 bp, Artificial Sequence; identical to SEQ ID NO: 11049
  Description of Artificial Sequence: Synthetic polynucleotide

SEQ ID NO: 12283 - DNA, 858 bp, Artificial Sequence; identical to SEQ ID NO: 11050
  Description of Artificial Sequence: Synthetic polynucleotide

SEQ ID NO: 12284 - DNA, 598 bp, Artificial Sequence; identical to SEQ ID NO: 11051
  Description of Artificial Sequence: Synthetic polynucleotide

SEQ ID NO: 12285 - DNA, 1281 bp, Artificial Sequence; identical to SEQ ID NO: 11052
  Description of Artificial Sequence: Synthetic polynucleotide

SEQ ID NO: 12286 - DNA, 1788 bp, Artificial Sequence; identical to SEQ ID NO: 11053
  Description of Artificial Sequence: Synthetic polynucleotide

SEQ ID NO: 12287 - DNA, 626 bp, Artificial Sequence; identical to SEQ ID NO: 11054
  Description of Artificial Sequence: Synthetic polynucleotide

SEQ ID NO: 12288 - DNA, 1037 bp, Artificial Sequence; identical to SEQ ID NO: 11055
  Description of Artificial Sequence: Synthetic polynucleotide

SEQ ID NO: 12289 - DNA, 977 bp, Artificial Sequence; identical to SEQ ID NO: 11056
  Description of Artificial Sequence: Synthetic polynucleotide

SEQ ID NO: 12290 - DNA, 6206 bp, Artificial Sequence; identical to SEQ ID NO: 11057
  Description of Artificial Sequence: Synthetic polynucleotide

SEQ ID NO: 12291 - DNA, 574 bp, Artificial Sequence; identical to SEQ ID NO: 11058
  Description of Artificial Sequence: Synthetic polynucleotide

SEQ ID NO: 12292 - DNA, 3438 bp, Artificial Sequence; identical to SEQ ID NO: 11059
  Description of Artificial Sequence: Synthetic polynucleotide

SEQ ID NO: 12293 - DNA, 4088 bp, Artificial Sequence; identical to SEQ ID NO: 11060
  Description of Artificial Sequence: Synthetic polynucleotide

SEQ ID NO: 12294 - DNA, 522 bp, Artificial Sequence; identical to SEQ ID NO: 11061
  Description of Artificial Sequence: Synthetic polynucleotide

SEQ ID NO: 12295 - DNA, 2260 bp, Artificial Sequence; identical to SEQ ID NO: 11062
  Description of Artificial Sequence: Synthetic polynucleotide

SEQ ID NO: 12296 - DNA, 1502 bp, Artificial Sequence; identical to SEQ ID NO: 11063
  Description of Artificial Sequence: Synthetic polynucleotide

SEQ ID NO: 12297 - DNA, 510 bp, Artificial Sequence; identical to SEQ ID NO: 11064
  Description of Artificial Sequence: Synthetic polynucleotide

SEQ ID NO: 12298 - DNA, 940 bp, Artificial Sequence; identical to SEQ ID NO: 11065
  Description of Artificial Sequence: Synthetic polynucleotide

SEQ ID NO: 12299 - DNA, 2718 bp, Artificial Sequence; identical to SEQ ID NO: 11066
  Description of Artificial Sequence: Synthetic polynucleotide

SEQ ID NO: 12300 - DNA, 2661 bp, Artificial Sequence; identical to SEQ ID NO: 11067
  Description of Artificial Sequence: Synthetic polynucleotide

SEQ ID NO: 12301 - DNA, 801 bp, Artificial Sequence; identical to SEQ ID NO: 11068
  Description of Artificial Sequence: Synthetic polynucleotide

SEQ ID NO: 12302 - DNA, 311 bp, Artificial Sequence; identical to SEQ ID NO: 11069
  Description of Artificial Sequence: Synthetic polynucleotide

SEQ ID NO: 12303 - DNA, 1048 bp, Artificial Sequence; identical to SEQ ID NO: 11070
  Description of Artificial Sequence: Synthetic polynucleotide

SEQ ID NO: 12304 - DNA, 301 bp, Artificial Sequence; identical to SEQ ID NO: 11071
  Description of Artificial Sequence: Synthetic polynucleotide

SEQ ID NO: 12305 - DNA, 1395 bp, Artificial Sequence; identical to SEQ ID NO: 11072
  Description of Artificial Sequence: Synthetic polynucleotide

SEQ ID NO: 12306 - DNA, 766 bp, Artificial Sequence; identical to SEQ ID NO: 11073
  Description of Artificial Sequence: Synthetic polynucleotide

SEQ ID NO: 12307 - DNA, 691 bp, Artificial Sequence; identical to SEQ ID NO: 11074
  Description of Artificial Sequence: Synthetic polynucleotide

SEQ ID NO: 12308 - DNA, 1024 bp, Artificial Sequence; identical to SEQ ID NO: 11075
  Description of Artificial Sequence: Synthetic polynucleotide

SEQ ID NO: 12309 - DNA, 1339 bp, Artificial Sequence; identical to SEQ ID NO: 11076
  Description of Artificial Sequence: Synthetic polynucleotide

SEQ ID NO: 12310 - DNA, 1376 bp, Artificial Sequence; identical to SEQ ID NO: 11085
  Description of Artificial Sequence: Synthetic polynucleotide

SEQ ID NO: 12311 - DNA, 3843 bp, Artificial Sequence; identical to SEQ ID NO: 11092
  Description of Artificial Sequence: Synthetic polynucleotide

SEQ ID NO: 12312 - DNA, 1622 bp, Artificial Sequence; identical to SEQ ID NO: 11100
  Description of Artificial Sequence: Synthetic polynucleotide

SEQ ID NO: 12313 - DNA, 1441 bp, Artificial Sequence; identical to SEQ ID NO: 11111
  Description of Artificial Sequence: Synthetic polynucleotide

SEQ ID NO: 12314 - DNA, 848 bp, Artificial Sequence; identical to SEQ ID NO: 11120
  Description of Artificial Sequence: Synthetic polynucleotide

SEQ ID NO: 12315 - DNA, 1230 bp, Artificial Sequence; identical to SEQ ID NO: 11121
  Description of Artificial Sequence: Synthetic polynucleotide

SEQ ID NO: 12316 - DNA, 2172 bp, Artificial Sequence; identical to SEQ ID NO: 11136
  Description of Artificial Sequence: Synthetic polynucleotide

SEQ ID NO: 12317 - DNA, 338 bp, Artificial Sequence; identical to SEQ ID NO: 11144
  Description of Artificial Sequence: Synthetic polynucleotide

SEQ ID NO: 12318 - DNA, 5715 bp, Artificial Sequence; identical to SEQ ID NO: 11152
  Description of Artificial Sequence: Synthetic polynucleotide

SEQ ID NO: 12319 - DNA, 1059 bp, Artificial Sequence; identical to SEQ ID NO: 11158
  Description of Artificial Sequence: Synthetic polynucleotide

SEQ ID NO: 12320 - DNA, 1503 bp, Artificial Sequence; identical to SEQ ID NO: 11166
  Description of Artificial Sequence: Synthetic polynucleotide

SEQ ID NO: 12321 - DNA, 1437 bp, Artificial Sequence; identical to SEQ ID NO: 11175
  Description of Artificial Sequence: Synthetic polynucleotide

SEQ ID NO: 12322 - DNA, 1203 bp, Artificial Sequence; identical to SEQ ID NO: 11184
  Description of Artificial Sequence: Synthetic polynucleotide

SEQ ID NO: 12323 - DNA, 206 bp, Artificial Sequence; identical to SEQ ID NO: 11190
  Description of Artificial Sequence: Synthetic polynucleotide

SEQ ID NO: 12324 - DNA, 1141 bp, Artificial Sequence; identical to SEQ ID NO: 11191
  Description of Artificial Sequence: Synthetic polynucleotide

SEQ ID NO: 12325 - DNA, 1819 bp, Artificial Sequence; identical to SEQ ID NO: 11192
  Description of Artificial Sequence: Synthetic polynucleotide

SEQ ID NO: 12326 - DNA, 1813 bp, Artificial Sequence; identical to SEQ ID NO: 11193
  Description of Artificial Sequence: Synthetic polynucleotide

SEQ ID NO: 12327 - DNA, 1872 bp, Artificial Sequence; identical to SEQ ID NO: 11194
  Description of Artificial Sequence: Synthetic polynucleotide

SEQ ID NO: 12328 - DNA, 652 bp, Artificial Sequence; identical to SEQ ID NO: 11195
  Description of Artificial Sequence: Synthetic polynucleotide

SEQ ID NO: 12329 - DNA, 722 bp, Artificial Sequence; identical to SEQ ID NO: 11196
  Description of Artificial Sequence: Synthetic polynucleotide

SEQ ID NO: 12330 - DNA, 858 bp, Artificial Sequence; identical to SEQ ID NO: 11197
  Description of Artificial Sequence: Synthetic polynucleotide

SEQ ID NO: 12331 - DNA, 598 bp, Artificial Sequence; identical to SEQ ID NO: 11198
  Description of Artificial Sequence: Synthetic polynucleotide

SEQ ID NO: 12332 - DNA, 1281 bp, Artificial Sequence; identical to SEQ ID NO: 11199
  Description of Artificial Sequence: Synthetic polynucleotide

SEQ ID NO: 12333 - DNA, 1788 bp, Artificial Sequence; identical to SEQ ID NO: 11200
  Description of Artificial Sequence: Synthetic polynucleotide

SEQ ID NO: 12334 - DNA, 626 bp, Artificial Sequence; identical to SEQ ID NO: 11201
  Description of Artificial Sequence: Synthetic polynucleotide

SEQ ID NO: 12335 - DNA, 1037 bp, Artificial Sequence; identical to SEQ ID NO: 11202
  Description of Artificial Sequence: Synthetic polynucleotide

SEQ ID NO: 12336 - DNA, 977 bp, Artificial Sequence; identical to SEQ ID NO: 11203
  Description of Artificial Sequence: Synthetic polynucleotide

SEQ ID NO: 12337 - DNA, 6206 bp, Artificial Sequence; identical to SEQ ID NO: 11204
  Description of Artificial Sequence: Synthetic polynucleotide

SEQ ID NO: 12338 - DNA, 574 bp, Artificial Sequence; identical to SEQ ID NO: 11205
  Description of Artificial Sequence: Synthetic polynucleotide

SEQ ID NO: 12339 - DNA, 3438 bp, Artificial Sequence; identical to SEQ ID NO: 11206
  Description of Artificial Sequence: Synthetic polynucleotide

SEQ ID NO: 12340 - DNA, 4088 bp, Artificial Sequence; identical to SEQ ID NO: 11207
  Description of Artificial Sequence: Synthetic polynucleotide

SEQ ID NO: 12341 - DNA, 522 bp, Artificial Sequence; identical to SEQ ID NO: 11208
  Description of Artificial Sequence: Synthetic polynucleotide

SEQ ID NO: 12342 - DNA, 2260 bp, Artificial Sequence; identical to SEQ ID NO: 11209
  Description of Artificial Sequence: Synthetic polynucleotide

SEQ ID NO: 12343 - DNA, 1502 bp, Artificial Sequence; identical to SEQ ID NO: 11210
  Description of Artificial Sequence: Synthetic polynucleotide

SEQ ID NO: 12344 - DNA, 510 bp, Artificial Sequence; identical to SEQ ID NO: 11211
  Description of Artificial Sequence: Synthetic polynucleotide

SEQ ID NO: 12345 - DNA, 940 bp, Artificial Sequence; identical to SEQ ID NO: 11212
  Description of Artificial Sequence: Synthetic polynucleotide

SEQ ID NO: 12346 - DNA, 2718 bp, Artificial Sequence; identical to SEQ ID NO: 11213
  Description of Artificial Sequence: Synthetic polynucleotide

SEQ ID NO: 12347 - DNA, 2661 bp, Artificial Sequence; identical to SEQ ID NO: 11214
  Description of Artificial Sequence: Synthetic polynucleotide

SEQ ID NO: 12348 - DNA, 801 bp, Artificial Sequence; identical to SEQ ID NO: 11215
  Description of Artificial Sequence: Synthetic polynucleotide

SEQ ID NO: 12349 - DNA, 311 bp, Artificial Sequence; identical to SEQ ID NO: 11216
  Description of Artificial Sequence: Synthetic polynucleotide

SEQ ID NO: 12350 - DNA, 1048 bp, Artificial Sequence; identical to SEQ ID NO: 11217
  Description of Artificial Sequence: Synthetic polynucleotide

SEQ ID NO: 12351 - DNA, 301 bp, Artificial Sequence; identical to SEQ ID NO: 11218
  Description of Artificial Sequence: Synthetic polynucleotide

SEQ ID NO: 12352 - DNA, 1395 bp, Artificial Sequence; identical to SEQ ID NO: 11219
  Description of Artificial Sequence: Synthetic polynucleotide

SEQ ID NO: 12353 - DNA, 766 bp, Artificial Sequence; identical to SEQ ID NO: 11220
  Description of Artificial Sequence: Synthetic polynucleotide

SEQ ID NO: 12354 - DNA, 691 bp, Artificial Sequence; identical to SEQ ID NO: 11221
  Description of Artificial Sequence: Synthetic polynucleotide

SEQ ID NO: 12355 - DNA, 1024 bp, Artificial Sequence; identical to SEQ ID NO: 11222
  Description of Artificial Sequence: Synthetic polynucleotide

SEQ ID NO: 12356 - DNA, 1339 bp, Artificial Sequence; identical to SEQ ID NO: 11223
  Description of Artificial Sequence: Synthetic polynucleotide

SEQ ID NO: 12357 - DNA, 1376 bp, Artificial Sequence; identical to SEQ ID NO: 11232
  Description of Artificial Sequence: Synthetic polynucleotide

SEQ ID NO: 12358 - DNA, 3843 bp, Artificial Sequence; identical to SEQ ID NO: 11239
  Description of Artificial Sequence: Synthetic polynucleotide

SEQ ID NO: 12359 - DNA, 1622 bp, Artificial Sequence; identical to SEQ ID NO: 11247
  Description of Artificial Sequence: Synthetic polynucleotide

SEQ ID NO: 12360 - DNA, 1441 bp, Artificial Sequence; identical to SEQ ID NO: 11258
  Description of Artificial Sequence: Synthetic polynucleotide

SEQ ID NO: 12361 - DNA, 848 bp, Artificial Sequence; identical to SEQ ID NO: 11267
  Description of Artificial Sequence: Synthetic polynucleotide

SEQ ID NO: 12362 - DNA, 1230 bp, Artificial Sequence; identical to SEQ ID NO: 11268
  Description of Artificial Sequence: Synthetic polynucleotide

SEQ ID NO: 12363 - DNA, 2172 bp, Artificial Sequence; identical to SEQ ID NO: 11283
  Description of Artificial Sequence: Synthetic polynucleotide

SEQ ID NO: 12364 - DNA, 338 bp, Artificial Sequence; identical to SEQ ID NO: 11291
  Description of Artificial Sequence: Synthetic polynucleotide

SEQ ID NO: 12365 - DNA, 5715 bp, Artificial Sequence; identical to SEQ ID NO: 11299
  Description of Artificial Sequence: Synthetic polynucleotide

SEQ ID NO: 12366 - DNA, 1059 bp, Artificial Sequence; identical to SEQ ID NO: 11305
  Description of Artificial Sequence: Synthetic polynucleotide

SEQ ID NO: 12367 - DNA, 1503 bp, Artificial Sequence; identical to SEQ ID NO: 11313
  Description of Artificial Sequence: Synthetic polynucleotide

SEQ ID NO: 12368 - DNA, 1437 bp, Artificial Sequence; identical to SEQ ID NO: 11322
  Description of Artificial Sequence: Synthetic polynucleotide

SEQ ID NO: 12369 - DNA, 1203 bp, Artificial Sequence; identical to SEQ ID NO: 11331
  Description of Artificial Sequence: Synthetic polynucleotide

SEQ ID NO: 12370 - DNA, 206 bp, Artificial Sequence; identical to SEQ ID NO: 11337
  Description of Artificial Sequence: Synthetic polynucleotide

SEQ ID NO: 12371 - DNA, 1141 bp, Artificial Sequence; identical to SEQ ID NO: 11338
  Description of Artificial Sequence: Synthetic polynucleotide

SEQ ID NO: 12372 - DNA, 1819 bp, Artificial Sequence; identical to SEQ ID NO: 11339
  Description of Artificial Sequence: Synthetic polynucleotide

SEQ ID NO: 12373 - DNA, 1813 bp, Artificial Sequence; identical to SEQ ID NO: 11340
  Description of Artificial Sequence: Synthetic polynucleotide

SEQ ID NO: 12374 - DNA, 1872 bp, Artificial Sequence; identical to SEQ ID NO: 11341
  Description of Artificial Sequence: Synthetic polynucleotide

SEQ ID NO: 12375 - DNA, 652 bp, Artificial Sequence; identical to SEQ ID NO: 11342
  Description of Artificial Sequence: Synthetic polynucleotide

SEQ ID NO: 12376 - DNA, 722 bp, Artificial Sequence; identical to SEQ ID NO: 11343
  Description of Artificial Sequence: Synthetic polynucleotide

SEQ ID NO: 12377 - DNA, 858 bp, Artificial Sequence; identical to SEQ ID NO: 11344
  Description of Artificial Sequence: Synthetic polynucleotide

SEQ ID NO: 12378 - DNA, 598 bp, Artificial Sequence; identical to SEQ ID NO: 11345
  Description of Artificial Sequence: Synthetic polynucleotide

SEQ ID NO: 12379 - DNA, 1281 bp, Artificial Sequence; identical to SEQ ID NO: 11346
  Description of Artificial Sequence: Synthetic polynucleotide

SEQ ID NO: 12380 - DNA, 1788 bp, Artificial Sequence; identical to SEQ ID NO: 11347
  Description of Artificial Sequence: Synthetic polynucleotide

SEQ ID NO: 12381 - DNA, 626 bp, Artificial Sequence; identical to SEQ ID NO: 11348
  Description of Artificial Sequence: Synthetic polynucleotide

SEQ ID NO: 12382 - DNA, 1037 bp, Artificial Sequence; identical to SEQ ID NO: 11349
  Description of Artificial Sequence: Synthetic polynucleotide

SEQ ID NO: 12383 - DNA, 977 bp, Artificial Sequence; identical to SEQ ID NO: 11350
  Description of Artificial Sequence: Synthetic polynucleotide

SEQ ID NO: 12384 - DNA, 6206 bp, Artificial Sequence; identical to SEQ ID NO: 11351
  Description of Artificial Sequence: Synthetic polynucleotide

SEQ ID NO: 12385 - DNA, 574 bp, Artificial Sequence; identical to SEQ ID NO: 11352
  Description of Artificial Sequence: Synthetic polynucleotide

SEQ ID NO: 12386 - DNA, 3438 bp, Artificial Sequence; identical to SEQ ID NO: 11353
  Description of Artificial Sequence: Synthetic polynucleotide

SEQ ID NO: 12387 - DNA, 4088 bp, Artificial Sequence; identical to SEQ ID NO: 11354
  Description of Artificial Sequence: Synthetic polynucleotide

SEQ ID NO: 12388 - DNA, 522 bp, Artificial Sequence; identical to SEQ ID NO: 11355
  Description of Artificial Sequence: Synthetic polynucleotide

SEQ ID NO: 12389 - DNA, 2260 bp, Artificial Sequence; identical to SEQ ID NO: 11356
  Description of Artificial Sequence: Synthetic polynucleotide

SEQ ID NO: 12390 - DNA, 1502 bp, Artificial Sequence; identical to SEQ ID NO: 11357
  Description of Artificial Sequence: Synthetic polynucleotide

SEQ ID NO: 12391 - DNA, 510 bp, Artificial Sequence; identical to SEQ ID NO: 11358
  Description of Artificial Sequence: Synthetic polynucleotide

SEQ ID NO: 12392 - DNA, 940 bp, Artificial Sequence; identical to SEQ ID NO: 11359
  Description of Artificial Sequence: Synthetic polynucleotide

SEQ ID NO: 12393 - DNA, 2718 bp, Artificial Sequence; identical to SEQ ID NO: 11360
  Description of Artificial Sequence: Synthetic polynucleotide

SEQ ID NO: 12394 - DNA, 2661 bp, Artificial Sequence; identical to SEQ ID NO: 11361
  Description of Artificial Sequence: Synthetic polynucleotide

SEQ ID NO: 12395 - DNA, 801 bp, Artificial Sequence; identical to SEQ ID NO: 11362
  Description of Artificial Sequence: Synthetic polynucleotide

SEQ ID NO: 12396 - DNA, 311 bp, Artificial Sequence; identical to SEQ ID NO: 11363
  Description of Artificial Sequence: Synthetic polynucleotide

SEQ ID NO: 12397 - DNA, 1048 bp, Artificial Sequence; identical to SEQ ID NO: 11364
  Description of Artificial Sequence: Synthetic polynucleotide

SEQ ID NO: 12398 - DNA, 301 bp, Artificial Sequence; identical to SEQ ID NO: 11365
  Description of Artificial Sequence: Synthetic polynucleotide

SEQ ID NO: 12399 - DNA, 1395 bp, Artificial Sequence; identical to SEQ ID NO: 11366
  Description of Artificial Sequence: Synthetic polynucleotide

SEQ ID NO: 12400 - DNA, 766 bp, Artificial Sequence; identical to SEQ ID NO: 11367
  Description of Artificial Sequence: Synthetic polynucleotide

SEQ ID NO: 12401 - DNA, 691 bp, Artificial Sequence; identical to SEQ ID NO: 11368
  Description of Artificial Sequence: Synthetic polynucleotide

SEQ ID NO: 12402 - DNA, 1024 bp, Artificial Sequence; identical to SEQ ID NO: 11369
  Description of Artificial Sequence: Synthetic polynucleotide

SEQ ID NO: 12403 - DNA, 1339 bp, Artificial Sequence; identical to SEQ ID NO: 11370
  Description of Artificial Sequence: Synthetic polynucleotide

SEQ ID NO: 12404 - DNA, 1376 bp, Artificial Sequence; identical to SEQ ID NO: 11379
  Description of Artificial Sequence: Synthetic polynucleotide

SEQ ID NO: 12405 - DNA, 3843 bp, Artificial Sequence; identical to SEQ ID NO: 11386
  Description of Artificial Sequence: Synthetic polynucleotide

SEQ ID NO: 12406 - DNA, 1622 bp, Artificial Sequence; identical to SEQ ID NO: 11394
  Description of Artificial Sequence: Synthetic polynucleotide

SEQ ID NO: 12407 - DNA, 1441 bp, Artificial Sequence; identical to SEQ ID NO: 11405
  Description of Artificial Sequence: Synthetic polynucleotide

SEQ ID NO: 12408 - DNA, 848 bp, Artificial Sequence; identical to SEQ ID NO: 11414
  Description of Artificial Sequence: Synthetic polynucleotide

SEQ ID NO: 12409 - DNA, 1230 bp, Artificial Sequence; identical to SEQ ID NO: 11415
  Description of Artificial Sequence: Synthetic polynucleotide

SEQ ID NO: 12410 - DNA, 2172 bp, Artificial Sequence; identical to SEQ ID NO: 11430
  Description of Artificial Sequence: Synthetic polynucleotide

SEQ ID NO: 12411 - DNA, 338 bp, Artificial Sequence; identical to SEQ ID NO: 11438
  Description of Artificial Sequence: Synthetic polynucleotide

SEQ ID NO: 12412 - DNA, 5715 bp, Artificial Sequence; identical to SEQ ID NO: 11446
  Description of Artificial Sequence: Synthetic polynucleotide

SEQ ID NO: 12413 - DNA, 1059 bp, Artificial Sequence; identical to SEQ ID NO: 11452
  Description of Artificial Sequence: Synthetic polynucleotide

SEQ ID NO: 12414 - DNA, 1503 bp, Artificial Sequence; identical to SEQ ID NO: 11460
  Description of Artificial Sequence: Synthetic polynucleotide

SEQ ID NO: 12415 - DNA, 1437 bp, Artificial Sequence; identical to SEQ ID NO: 11469
  Description of Artificial Sequence: Synthetic polynucleotide

SEQ ID NO: 12416 - DNA, 1203 bp, Artificial Sequence; identical to SEQ ID NO: 11478
  Description of Artificial Sequence: Synthetic polynucleotide

SEQ ID NO: 12417 - DNA, 206 bp, Artificial Sequence; identical to SEQ ID NO: 11484
  Description of Artificial Sequence: Synthetic polynucleotide

SEQ ID NO: 12418 - DNA, 1141 bp, Artificial Sequence; identical to SEQ ID NO: 11485
  Description of Artificial Sequence: Synthetic polynucleotide

SEQ ID NO: 12419 - DNA, 1819 bp, Artificial Sequence; identical to SEQ ID NO: 11486
  Description of Artificial Sequence: Synthetic polynucleotide

SEQ ID NO: 12420 - DNA, 1813 bp, Artificial Sequence; identical to SEQ ID NO: 11487
  Description of Artificial Sequence: Synthetic polynucleotide

SEQ ID NO: 12421 - DNA, 1872 bp, Artificial Sequence; identical to SEQ ID NO: 11488
  Description of Artificial Sequence: Synthetic polynucleotide

SEQ ID NO: 12422 - DNA, 652 bp, Artificial Sequence; identical to SEQ ID NO: 11489
  Description of Artificial Sequence: Synthetic polynucleotide

SEQ ID NO: 12423 - DNA, 722 bp, Artificial Sequence; identical to SEQ ID NO: 11490
  Description of Artificial Sequence: Synthetic polynucleotide

SEQ ID NO: 12424 - DNA, 858 bp, Artificial Sequence; identical to SEQ ID NO: 11491
  Description of Artificial Sequence: Synthetic polynucleotide

SEQ ID NO: 12425 - DNA, 598 bp, Artificial Sequence; identical to SEQ ID NO: 11492
  Description of Artificial Sequence: Synthetic polynucleotide

SEQ ID NO: 12426 - DNA, 1281 bp, Artificial Sequence; identical to SEQ ID NO: 11493
  Description of Artificial Sequence: Synthetic polynucleotide

SEQ ID NO: 12427 - DNA, 1788 bp, Artificial Sequence; identical to SEQ ID NO: 11494
  Description of Artificial Sequence: Synthetic polynucleotide

SEQ ID NO: 12428 - DNA, 626 bp, Artificial Sequence; identical to SEQ ID NO: 11495
  Description of Artificial Sequence: Synthetic polynucleotide

SEQ ID NO: 12429 - DNA, 1037 bp, Artificial Sequence; identical to SEQ ID NO: 11496
  Description of Artificial Sequence: Synthetic polynucleotide

SEQ ID NO: 12430 - DNA, 977 bp, Artificial Sequence; identical to SEQ ID NO: 11497
  Description of Artificial Sequence: Synthetic polynucleotide

SEQ ID NO: 12431 - DNA, 6206 bp, Artificial Sequence; identical to SEQ ID NO: 11498
  Description of Artificial Sequence: Synthetic polynucleotide

SEQ ID NO: 12432 - DNA, 574 bp, Artificial Sequence; identical to SEQ ID NO: 11499
  Description of Artificial Sequence: Synthetic polynucleotide

SEQ ID NO: 12433 - DNA, 3438 bp, Artificial Sequence; identical to SEQ ID NO: 11500
  Description of Artificial Sequence: Synthetic polynucleotide

SEQ ID NO: 12434 - DNA, 4088 bp, Artificial Sequence; identical to SEQ ID NO: 11501
  Description of Artificial Sequence: Synthetic polynucleotide

SEQ ID NO: 12435 - DNA, 522 bp, Artificial Sequence; identical to SEQ ID NO: 11502
  Description of Artificial Sequence: Synthetic polynucleotide

SEQ ID NO: 12436 - DNA, 2260 bp, Artificial Sequence; identical to SEQ ID NO: 11503
  Description of Artificial Sequence: Synthetic polynucleotide

SEQ ID NO: 12437 - DNA, 1502 bp, Artificial Sequence; identical to SEQ ID NO: 11504
  Description of Artificial Sequence: Synthetic polynucleotide

SEQ ID NO: 12438 - DNA, 510 bp, Artificial Sequence; identical to SEQ ID NO: 11505
  Description of Artificial Sequence: Synthetic polynucleotide

SEQ ID NO: 12439 - DNA, 940 bp, Artificial Sequence; identical to SEQ ID NO: 11506
  Description of Artificial Sequence: Synthetic polynucleotide

SEQ ID NO: 12440 - DNA, 2718 bp, Artificial Sequence; identical to SEQ ID NO: 11507
  Description of Artificial Sequence: Synthetic polynucleotide

SEQ ID NO: 12441 - DNA, 2661 bp, Artificial Sequence; identical to SEQ ID NO: 11508
  Description of Artificial Sequence: Synthetic polynucleotide

SEQ ID NO: 12442 - DNA, 801 bp, Artificial Sequence; identical to SEQ ID NO: 11509
  Description of Artificial Sequence: Synthetic polynucleotide

SEQ ID NO: 12443 - DNA, 311 bp, Artificial Sequence; identical to SEQ ID NO: 11510
  Description of Artificial Sequence: Synthetic polynucleotide

SEQ ID NO: 12444 - DNA, 1048 bp, Artificial Sequence; identical to SEQ ID NO: 11511
  Description of Artificial Sequence: Synthetic polynucleotide

SEQ ID NO: 12445 - DNA, 301 bp, Artificial Sequence; identical to SEQ ID NO: 11512
  Description of Artificial Sequence: Synthetic polynucleotide

SEQ ID NO: 12446 - DNA, 1395 bp, Artificial Sequence; identical to SEQ ID NO: 11513
  Description of Artificial Sequence: Synthetic polynucleotide

SEQ ID NO: 12447 - DNA, 766 bp, Artificial Sequence; identical to SEQ ID NO: 11514
  Description of Artificial Sequence: Synthetic polynucleotide

SEQ ID NO: 12448 - DNA, 691 bp, Artificial Sequence; identical to SEQ ID NO: 11515
  Description of Artificial Sequence: Synthetic polynucleotide

SEQ ID NO: 12449 - DNA, 1024 bp, Artificial Sequence; identical to SEQ ID NO: 11516
  Description of Artificial Sequence: Synthetic polynucleotide

SEQ ID NO: 12450 - DNA, 1339 bp, Artificial Sequence; identical to SEQ ID NO: 11517
  Description of Artificial Sequence: Synthetic polynucleotide

SEQ ID NO: 12451 - DNA, 1376 bp, Artificial Sequence; identical to SEQ ID NO: 11526
  Description of Artificial Sequence: Synthetic polynucleotide

SEQ ID NO: 12452 - DNA, 3843 bp, Artificial Sequence; identical to SEQ ID NO: 11533
  Description of Artificial Sequence: Synthetic polynucleotide

SEQ ID NO: 12453 - DNA, 1622 bp, Artificial Sequence; identical to SEQ ID NO: 11541
  Description of Artificial Sequence: Synthetic polynucleotide

SEQ ID NO: 12454 - DNA, 1441 bp, Artificial Sequence; identical to SEQ ID NO: 11552
  Description of Artificial Sequence: Synthetic polynucleotide

SEQ ID NO: 12455 - DNA, 383 bp, Homo sapiens; identical to SEQ ID NO: 8556

SEQ ID NO: 12456 - DNA, 116 bp, Homo sapiens; identical to SEQ ID NO: 8448

SEQ ID NO: 12457 - DNA, 264 bp, Homo sapiens; identical to SEQ ID NO: 8503

SEQ ID NO: 12458 - DNA, 521 bp, Homo sapiens; identical to SEQ ID NO: 8546

SEQ ID NO: 12459 - DNA, 109 bp, Homo sapiens; identical to SEQ ID NO: 8553

SEQ ID NO: 12460 - DNA, 1041 bp, Homo sapiens; identical to SEQ ID NO: 8562

SEQ ID NO: 12461 - DNA, 383 bp, Homo sapiens; identical to SEQ ID NO: 8742

SEQ ID NO: 12462 - DNA, 116 bp, Homo sapiens; identical to SEQ ID NO: 8634

SEQ ID NO: 12463 - DNA, 264 bp, Homo sapiens; identical to SEQ ID NO: 8689

SEQ ID NO: 12464 - DNA, 521 bp, Homo sapiens; identical to SEQ ID NO: 8732

SEQ ID NO: 12465 - DNA, 109 bp, Homo sapiens; identical to SEQ ID NO: 8739

SEQ ID NO: 12466 - DNA, 1041 bp, Homo sapiens; identical to SEQ ID NO: 8748

SEQ ID NO: 12467 - DNA, 383 bp, Artificial Sequence; identical to SEQ ID NO: 8928
  Description of Artificial Sequence: Synthetic polynucleotide

SEQ ID NO: 12468 - DNA, 116 bp, Artificial Sequence; identical to SEQ ID NO: 8820
  Description of Artificial Sequence: Synthetic polynucleotide

SEQ ID NO: 12469 - DNA, 264 bp, Artificial Sequence; identical to SEQ ID NO: 8875
  Description of Artificial Sequence: Synthetic polynucleotide

SEQ ID NO: 12470 - DNA, 521 bp, Artificial Sequence; identical to SEQ ID NO: 8918
  Description of Artificial Sequence: Synthetic polynucleotide

SEQ ID NO: 12471 - DNA, 109 bp, Artificial Sequence; identical to SEQ ID NO: 8925
  Description of Artificial Sequence: Synthetic polynucleotide

SEQ ID NO: 12472 - DNA, 1041 bp, Artificial Sequence; identical to SEQ ID NO: 8934
  Description of Artificial Sequence: Synthetic polynucleotide

SEQ ID NO: 12473 - DNA, 383 bp, Artificial Sequence; identical to SEQ ID NO: 9114
  Description of Artificial Sequence: Synthetic polynucleotide

SEQ ID NO: 12474 - DNA, 116 bp, Artificial Sequence; identical to SEQ ID NO: 9006
  Description of Artificial Sequence: Synthetic polynucleotide

SEQ ID NO: 12475 - DNA, 264 bp, Artificial Sequence; identical to SEQ ID NO: 9061
  Description of Artificial Sequence: Synthetic polynucleotide

SEQ ID NO: 12476 - DNA, 521 bp, Artificial Sequence; identical to SEQ ID NO: 9104
  Description of Artificial Sequence: Synthetic polynucleotide

SEQ ID NO: 12477 - DNA, 109 bp, Artificial Sequence; identical to SEQ ID NO: 9111
  Description of Artificial Sequence: Synthetic polynucleotide

SEQ ID NO: 12478 - DNA, 1041 bp, Artificial Sequence; identical to SEQ ID NO: 9120
  Description of Artificial Sequence: Synthetic polynucleotide

SEQ ID NO: 12479 - DNA, 383 bp, Artificial Sequence; identical to SEQ ID NO: 9300
  Description of Artificial Sequence: Synthetic polynucleotide

SEQ ID NO: 12480 - DNA, 116 bp, Artificial Sequence; identical to SEQ ID NO: 9192
  Description of Artificial Sequence: Synthetic polynucleotide

SEQ ID NO: 12481 - DNA, 264 bp, Artificial Sequence; identical to SEQ ID NO: 9247
  Description of Artificial Sequence: Synthetic polynucleotide

SEQ ID NO: 12482 - DNA, 521 bp, Artificial Sequence; identical to SEQ ID NO: 9290
  Description of Artificial Sequence: Synthetic polynucleotide

SEQ ID NO: 12483 - DNA, 109 bp, Artificial Sequence; identical to SEQ ID NO: 9297
  Description of Artificial Sequence: Synthetic polynucleotide

SEQ ID NO: 12484 - DNA, 1041 bp, Artificial Sequence; identical to SEQ ID NO: 9306
  Description of Artificial Sequence: Synthetic polynucleotide

SEQ ID NO: 12485 - DNA, 383 bp, Artificial Sequence; identical to SEQ ID NO: 9486
  Description of Artificial Sequence: Synthetic polynucleotide

SEQ ID NO: 12486 - DNA, 116 bp, Artificial Sequence; identical to SEQ ID NO: 9378
  Description of Artificial Sequence: Synthetic polynucleotide

SEQ ID NO: 12487 - DNA, 264 bp, Artificial Sequence; identical to SEQ ID NO: 9433
  Description of Artificial Sequence: Synthetic polynucleotide

SEQ ID NO: 12488 - DNA, 521 bp, Artificial Sequence; identical to SEQ ID NO: 9476
  Description of Artificial Sequence: Synthetic polynucleotide

SEQ ID NO: 12489 - DNA, 109 bp, Artificial Sequence; identical to SEQ ID NO: 9483
  Description of Artificial Sequence: Synthetic polynucleotide

SEQ ID NO: 12490 - DNA, 1041 bp, Artificial Sequence; identical to SEQ ID NO: 9492
  Description of Artificial Sequence: Synthetic polynucleotide

SEQ ID NO: 12491 - DNA, 582 bp, Homo sapiens; identical to SEQ ID NO: 9672

SEQ ID NO: 12492 - DNA, 315 bp, Homo sapiens; identical to SEQ ID NO: 9564

SEQ ID NO: 12493 - DNA, 463 bp, Homo sapiens; identical to SEQ ID NO: 9619

SEQ ID NO: 12494 - DNA, 720 bp, Homo sapiens; identical to SEQ ID NO: 9662

SEQ ID NO: 12495 - DNA, 308 bp, Homo sapiens; identical to SEQ ID NO: 9669

SEQ ID NO: 12496 - DNA, 1240 bp, Homo sapiens; identical to SEQ ID NO: 9678

SEQ ID NO: 12497 - DNA, 582 bp, Homo sapiens; identical to SEQ ID NO: 9858

SEQ ID NO: 12498 - DNA, 315 bp, Homo sapiens; identical to SEQ ID NO: 9750

SEQ ID NO: 12499 - DNA, 463 bp, Homo sapiens; identical to SEQ ID NO: 9805

SEQ ID NO: 12500 - DNA, 720 bp, Homo sapiens; identical to SEQ ID NO: 9848

SEQ ID NO: 12501 - DNA, 308 bp, Homo sapiens; identical to SEQ ID NO: 9855

SEQ ID NO: 12502 - DNA, 1240 bp, Homo sapiens; identical to SEQ ID NO: 9864

SEQ ID NO: 12503 - DNA, 582 bp, Artificial Sequence; identical to SEQ ID NO: 10044
  Description of Artificial Sequence: Synthetic polynucleotide

SEQ ID NO: 12504 - DNA, 315 bp, Artificial Sequence; identical to SEQ ID NO: 9936
  Description of Artificial Sequence: Synthetic polynucleotide

SEQ ID NO: 12505 - DNA, 463 bp, Artificial Sequence; identical to SEQ ID NO: 9991
  Description of Artificial Sequence: Synthetic polynucleotide

SEQ ID NO: 12506 - DNA, 720 bp, Artificial Sequence; identical to SEQ ID NO: 10034
  Description of Artificial Sequence: Synthetic polynucleotide

SEQ ID NO: 12507 - DNA, 308 bp, Artificial Sequence; identical to SEQ ID NO: 10041
  Description of Artificial Sequence: Synthetic polynucleotide

SEQ ID NO: 12508 - DNA, 1240 bp, Artificial Sequence; identical to SEQ ID NO: 10050
  Description of Artificial Sequence: Synthetic polynucleotide

SEQ ID NO: 12509 - DNA, 582 bp, Artificial Sequence; identical to SEQ ID NO: 10230
  Description of Artificial Sequence: Synthetic polynucleotide

SEQ ID NO: 12510 - DNA, 315 bp, Artificial Sequence; identical to SEQ ID NO: 10122
  Description of Artificial Sequence: Synthetic polynucleotide

SEQ ID NO: 12511 - DNA, 463 bp, Artificial Sequence; identical to SEQ ID NO: 10177
  Description of Artificial Sequence: Synthetic polynucleotide

SEQ ID NO: 12512 - DNA, 720 bp, Artificial Sequence; identical to SEQ ID NO: 10220
  Description of Artificial Sequence: Synthetic polynucleotide

SEQ ID NO: 12513 - DNA, 308 bp, Artificial Sequence; identical to SEQ ID NO: 10227
  Description of Artificial Sequence: Synthetic polynucleotide

SEQ ID NO: 12514 - DNA, 1240 bp, Artificial Sequence; identical to SEQ ID NO: 10236
  Description of Artificial Sequence: Synthetic polynucleotide

SEQ ID NO: 12515 - DNA, 582 bp, Artificial Sequence; identical to SEQ ID NO: 10416
  Description of Artificial Sequence: Synthetic polynucleotide

SEQ ID NO: 12516 - DNA, 315 bp, Artificial Sequence; identical to SEQ ID NO: 10308
  Description of Artificial Sequence: Synthetic polynucleotide

SEQ ID NO: 12517 - DNA, 463 bp, Artificial Sequence; identical to SEQ ID NO: 10363
  Description of Artificial Sequence: Synthetic polynucleotide

SEQ ID NO: 12518 - DNA, 720 bp, Artificial Sequence; identical to SEQ ID NO: 10406
  Description of Artificial Sequence: Synthetic polynucleotide

SEQ ID NO: 12519 - DNA, 308 bp, Artificial Sequence; identical to SEQ ID NO: 10413
  Description of Artificial Sequence: Synthetic polynucleotide

SEQ ID NO: 12520 - DNA, 1240 bp, Artificial Sequence; identical to SEQ ID NO: 10422
  Description of Artificial Sequence: Synthetic polynucleotide

SEQ ID NO: 12521 - DNA, 582 bp, Artificial Sequence; identical to SEQ ID NO: 10602
  Description of Artificial Sequence: Synthetic polynucleotide

SEQ ID NO: 12522 - DNA, 315 bp, Artificial Sequence; identical to SEQ ID NO: 10494
  Description of Artificial Sequence: Synthetic polynucleotide

SEQ ID NO: 12523 - DNA, 463 bp, Artificial Sequence; identical to SEQ ID NO: 10549
  Description of Artificial Sequence: Synthetic polynucleotide

SEQ ID NO: 12524 - DNA, 720 bp, Artificial Sequence; identical to SEQ ID NO: 10592
  Description of Artificial Sequence: Synthetic polynucleotide

SEQ ID NO: 12525 - DNA, 308 bp, Artificial Sequence; identical to SEQ ID NO: 10599
  Description of Artificial Sequence: Synthetic polynucleotide

SEQ ID NO: 12526 - DNA, 1240 bp, Artificial Sequence; identical to SEQ ID NO: 10608
  Description of Artificial Sequence: Synthetic polynucleotide

SEQ ID NO: 12527 - DNA, 1788 bp, Homo sapiens; identical to SEQ ID NO: 10759

SEQ ID NO: 12528 - DNA, 1230 bp, Homo sapiens; identical to SEQ ID NO: 10680

SEQ ID NO: 12529 - DNA, 1059 bp, Homo sapiens; identical to SEQ ID NO: 10717

SEQ ID NO: 12530 - DNA, 1819 bp, Homo sapiens; identical to SEQ ID NO: 10751

SEQ ID NO: 12531 - DNA, 598 bp, Homo sapiens; identical to SEQ ID NO: 10757

SEQ ID NO: 12532 - DNA, 3438 bp, Homo sapiens; identical to SEQ ID NO: 10765

SEQ ID NO: 12533 - DNA, 1788 bp, Homo sapiens; identical to SEQ ID NO: 10906

SEQ ID NO: 12534 - DNA, 1230 bp, Homo sapiens; identical to SEQ ID NO: 10827

SEQ ID NO: 12535 - DNA, 1059 bp, Homo sapiens; identical to SEQ ID NO: 10864

SEQ ID NO: 12536 - DNA, 1819 bp, Homo sapiens; identical to SEQ ID NO: 10898

SEQ ID NO: 12537 - DNA, 598 bp, Homo sapiens; identical to SEQ ID NO: 10904

SEQ ID NO: 12538 - DNA, 3438 bp, Homo sapiens; identical to SEQ ID NO: 10912

SEQ ID NO: 12539 - DNA, 1788 bp, Artificial Sequence; identical to SEQ ID NO: 11053
  Description of Artificial Sequence: Synthetic polynucleotide

SEQ ID NO: 12540 - DNA, 1230 bp, Artificial Sequence; identical to SEQ ID NO: 10974
  Description of Artificial Sequence: Synthetic polynucleotide

SEQ ID NO: 12541 - DNA, 1059 bp, Artificial Sequence; identical to SEQ ID NO: 11011
  Description of Artificial Sequence: Synthetic polynucleotide

SEQ ID NO: 12542 - DNA, 1819 bp, Artificial Sequence; identical to SEQ ID NO: 11045
  Description of Artificial Sequence: Synthetic polynucleotide

SEQ ID NO: 12543 - DNA, 598 bp, Artificial Sequence; identical to SEQ ID NO: 11051
  Description of Artificial Sequence: Synthetic polynucleotide

SEQ ID NO: 12544 - DNA, 3438 bp, Artificial Sequence; identical to SEQ ID NO: 11059
  Description of Artificial Sequence: Synthetic polynucleotide

SEQ ID NO: 12545 - DNA, 1788 bp, Artificial Sequence; identical to SEQ ID NO: 11200
  Description of Artificial Sequence: Synthetic polynucleotide

SEQ ID NO: 12546 - DNA, 1230 bp, Artificial Sequence; identical to SEQ ID NO: 11121
  Description of Artificial Sequence: Synthetic polynucleotide

SEQ ID NO: 12547 - DNA, 1059 bp, Artificial Sequence; identical to SEQ ID NO: 11158
  Description of Artificial Sequence: Synthetic polynucleotide

SEQ ID NO: 12548 - DNA, 1819 bp, Artificial Sequence; identical to SEQ ID NO: 11192
  Description of Artificial Sequence: Synthetic polynucleotide

SEQ ID NO: 12549 - DNA, 598 bp, Artificial Sequence; identical to SEQ ID NO: 11198
  Description of Artificial Sequence: Synthetic polynucleotide

SEQ ID NO: 12550 - DNA, 3438 bp, Artificial Sequence; identical to SEQ ID NO: 11206
  Description of Artificial Sequence: Synthetic polynucleotide

SEQ ID NO: 12551 - DNA, 1788 bp, Artificial Sequence; identical to SEQ ID NO: 11347
  Description of Artificial Sequence: Synthetic polynucleotide

SEQ ID NO: 12552 - DNA, 1230 bp, Artificial Sequence; identical to SEQ ID NO: 11268
  Description of Artificial Sequence: Synthetic polynucleotide

SEQ ID NO: 12553 - DNA, 1059 bp, Artificial Sequence; identical to SEQ ID NO: 11305
  Description of Artificial Sequence: Synthetic polynucleotide

SEQ ID NO: 12554 - DNA, 1819 bp, Artificial Sequence; identical to SEQ ID NO: 11339
  Description of Artificial Sequence: Synthetic polynucleotide

SEQ ID NO: 12555 - DNA, 598 bp, Artificial Sequence; identical to SEQ ID NO: 11345
  Description of Artificial Sequence: Synthetic polynucleotide

SEQ ID NO: 12556 - DNA, 3438 bp, Artificial Sequence; identical to SEQ ID NO: 11353
  Description of Artificial Sequence: Synthetic polynucleotide

SEQ ID NO: 12557 - DNA, 1788 bp, Artificial Sequence; identical to SEQ ID NO: 11494
  Description of Artificial Sequence: Synthetic polynucleotide

SEQ ID NO: 12558 - DNA, 1230 bp, Artificial Sequence; identical to SEQ ID NO: 11415
  Description of Artificial Sequence: Synthetic polynucleotide

SEQ ID NO: 12559 - DNA, 1059 bp, Artificial Sequence; identical to SEQ ID NO: 11452
  Description of Artificial Sequence: Synthetic polynucleotide

SEQ ID NO: 12560 - DNA, 1819 bp, Artificial Sequence; identical to SEQ ID NO: 11486
  Description of Artificial Sequence: Synthetic polynucleotide

SEQ ID NO: 12561 - DNA, 598 bp, Artificial Sequence; identical to SEQ ID NO: 11492
  Description of Artificial Sequence: Synthetic polynucleotide

SEQ ID NO: 12562 - DNA, 3438 bp, Artificial Sequence; identical to SEQ ID NO: 11500
  Description of Artificial Sequence: Synthetic polynucleotide

SEQ ID NO: 12563 - DNA, 782 bp, Homo sapiens
gcgcttccgagccacgcagaggcgccccctcccgccggagacgggaaagccccggcgcccccagactgggctccgtttccagctcccggaggggctggggctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaacgtaagtggggaccggggaggcgagggtggaggtggccgcggcaggggctgcacggg

SEQ ID NO: 12564 - DNA, 615 bp, Homo sapiens
ccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgc

SEQ ID NO: 12565 - DNA, 763 bp, Homo sapiens
gggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgg

SEQ ID NO: 12566 - DNA, 1020 bp, Homo sapiens
ttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcat

SEQ ID NO: 12567 - DNA, 608 bp, Homo sapiens
gcgggtcccaccctctctcctgccaggggtagaccctgggaccactcagctcgctctcgcaggccctgagcgtctgacgcctgcgcactgagcgcgggcgggcgggcactcccagaaacctccggggcgctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaaggtaggagtgtccgggatgccggagcggacacgcgcggagaaagcgtcgctggggttactcgtgtggccgtgtctccggttttgtgtgcaggctacagcctgcctggtattggcgactgcctgtgcatacacgactggacgtgtgtg

SEQ ID NO: 12568 - DNA, 1539 bp, Homo sapiens
tctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgccgcgaccgcccggcccacggccggaaggcttggacggcgcctcgtacccagccaggtctcccctacctggcccaacccaagccagcccagaacgcatactatgtgtgcaccagagcccaggacaggttcccctcgagcgatgtacaggtc

SEQ ID NO: 12569 - DNA, 782 bp, Artificial Sequence
  Description of Artificial Sequence: Synthetic polynucleotide
gygttttygagttaygtagaggygttttttttygtyggagaygggaaagtttyggygtttttagattgggtttygtttttagttttyggaggggttggggttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaagattttygagtttaaagagattttyggaaygtaagtggggatyggggaggygagggtggaggtggtygyggtaggggttgtayggg

SEQ ID NO: 12570 - DNA, 615 bp, Artificial Sequence
  Description of Artificial Sequence: Synthetic polynucleotide
tygtgattttttttattttttygattttttaggttttttatagtgattttttatygtgttttattttatgaatygttagagttattygtttttaaattttaaattttgygtaatgtttttttatagatttttttaggtattaygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygttyggygtyggagttatgatttttygtygatttaggaagttgtagtagaaggaggaggyggyggttatttyggatttygtygttyggattttygattyggaagtygygttygtygtttyggtttygatttygggattttttgtygtagtygt

SEQ ID NO: 12571 - DNA, 763 bp, Artificial Sequence
  Description of Artificial Sequence: Synthetic polynucleotide
gggaaygagatattgttgagttggaagatttygygggttataggtatagtttttttgttgttggyggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygttggggtttygggyggtayggggygygggtgggtyggttggtgagygttatygtgtttgttttyggtttgttttgggttttttattaygtagttaattttttgtaggyggtygtagygttggttttatyggaaggggttttggygaagttgg

SEQ ID NO: 12572 - DNA, 1020 bp, Artificial Sequence
  Description of Artificial Sequence: Synthetic polynucleotide
ttggggtagttttttttttgtttatttattgtttagtttttttttttatattttttttyggaaaygtttgtttttgataaggtttattttttgtttttaggaggtttttattgtggaggaagggaggygtygttygtttttggtttttttgatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagygygggygyggygttttagttagygygtagggttygggtttygtygggggygttttttygtygttgtttttygygygattygttgtttattagttattat

SEQ ID NO: 12573 - DNA, 608 bp, Artificial Sequence
  Description of Artificial Sequence: Synthetic polynucleotide
gygggttttatttttttttttgttaggggtagattttgggattatttagttygttttygtaggttttgagygtttgaygtttgygtattgagygygggygggygggtatttttagaaattttyggggygttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgttaaggtaggagtgttygggatgtyggagyggataygygyggagaaagygtygttggggttattygtgtggtygtgttttyggttttgtgtgtaggttatagtttgtttggtattggygattgtttgtgtatataygattggaygtgtgtg

SEQ ID NO: 12574 - DNA, 1539 bp, Artificial Sequence
  Description of Artificial Sequence: Synthetic polynucleotide
tttggttttatgtttagtttygyggttatygttgaagygaggygtagtygtygttgtygttygggaaattttgyggtyggtyggagygygtygagttaagygygggggggaagagyggagaagagttggggaggyggggagygagggygtagygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtygygatygttyggtttayggtyggaaggtttggayggygtttygtatttagttaggttttttttatttggtttaatttaagttagtttagaaygtatattatgtgtgtattagagtttaggataggtttttttygagygatgtataggtt

SEQ ID NO: 12575 - DNA, 782 bp, Artificial Sequence
  Description of Artificial Sequence: Synthetic polynucleotide
gcgttttcgagttacgtagaggcgttttttttcgtcggagacgggaaagtttcggcgtttttagattgggtttcgtttttagttttcggaggggttggggttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaagattttcgagtttaaagagattttcggaacgtaagtggggatcggggaggcgagggtggaggtggtcgcggtaggggttgtacggg

SEQ ID NO: 12576 - DNA, 615 bp, Artificial Sequence
  Description of Artificial Sequence: Synthetic polynucleotide
tcgtgattttttttattttttcgattttttaggttttttatagtgattttttatcgtgttttattttatgaatcgttagagttattcgtttttaaattttaaattttgcgtaatgtttttttatagatttttttaggtattacgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgttcggcgtcggagttatgatttttcgtcgatttaggaagttgtagtagaaggaggaggcggcggttatttcggatttcgtcgttcggattttcgattcggaagtcgcgttcgtcgtttcggtttcgatttcgggattttttgtcgtagtcgt

SEQ ID NO: 12577 - DNA, 763 bp, Artificial Sequence
  Description of Artificial Sequence: Synthetic polynucleotide
gggaacgagatattgttgagttggaagatttcgcgggttataggtatagtttttttgttgttggcggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgttggggtttcgggcggtacggggcgcgggtgggtcggttggtgagcgttatcgtgtttgttttcggtttgttttgggttttttattacgtagttaattttttgtaggcggtcgtagcgttggttttatcggaaggggttttggcgaagttgg

SEQ ID NO: 12578 - DNA, 1020 bp, Artificial Sequence
  Description of Artificial Sequence: Synthetic polynucleotide
ttggggtagttttttttttgtttatttattgtttagtttttttttttatattttttttcggaaacgtttgtttttgataaggtttattttttgtttttaggaggtttttattgtggaggaagggaggcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattat

SEQ ID NO: 12579 - DNA, 608 bp, Artificial Sequence
  Description of Artificial Sequence: Synthetic polynucleotide
gcgggttttatttttttttttgttaggggtagattttgggattatttagttcgttttcgtaggttttgagcgtttgacgtttgcgtattgagcgcgggcgggcgggtatttttagaaattttcggggcgttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgttaaggtaggagtgttcgggatgtcggagcggatacgcgcggagaaagcgtcgttggggttattcgtgtggtcgtgttttcggttttgtgtgtaggttatagtttgtttggtattggcgattgtttgtgtatatacgattggacgtgtgtg

SEQ ID NO: 12580 - DNA, 1539 bp, Artificial Sequence
  Description of Artificial Sequence: Synthetic polynucleotide
tttggttttatgtttagtttcgcggttatcgttgaagcgaggcgtagtcgtcgttgtcgttcgggaaattttgcggtcggtcggagcgcgtcgagttaagcgcgggggggaagagcggagaagagttggggaggcggggagcgagggcgtagcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtcgcgatcgttcggtttacggtcggaaggtttggacggcgtttcgtatttagttaggttttttttatttggtttaatttaagttagtttagaacgtatattatgtgtgtattagagtttaggataggtttttttcgagcgatgtataggtt

SEQ ID NO: 12581 - DNA, 782 bp, Homo sapiens
cccgtgcagcccctgccgcggccacctccaccctcgcctccccggtccccacttacgttccgagggtctctttgaactcgaagatcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagagccccagcccctccgggagctggaaacggagcccagtctgggggcgccggggctttcccgtctccggcgggagggggcgcctctgcgtggctcggaagcgc

SEQ ID NO: 12582 - DNA, 615 bp, Homo sapiens
gcggctgcggcagggggtcccggggtcgggaccggagcggcgggcgcgacttccgagtcgggagtccgggcggcggggtccggggtggccgccgcctcctccttctgctgcagcttcctgagtcggcggagggtcatggctccggcgccggacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgtgatacctggaggggtctgtgaagggacattgcgcaaggtttgaaatttagggacgaatagctctggcgattcatggagtggggcacggtaagaggtcactgtaagaagcctggggagtcggggaggtagggagagtcacgg

SEQ ID NO: 12583 - DNA, 763 bp, Homo sapiens
ccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccc

SEQ ID NO: 12584 - DNA, 1020 bp, Homo sapiens
atgatggctggtgggcagcgggtcgcgcggagggcagcggcgaggaagcgcccccggcggggcccgggccctgcgcgctggctggggcgccgcgcccgcgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtcagagaagccagggacgggcgacgcctcccttcctccacaataagggcctcctgagagcaggaagtagaccttgtcaggagcagacgtttccgaaggaaggtgtgaaggaaggagctaggcagtgagtgagcagaaagggagctgccccaa

SEQ ID NO: 12585 - DNA, 608 bp, Homo sapiens
cacacacgtccagtcgtgtatgcacaggcagtcgccaataccaggcaggctgtagcctgcacacaaaaccggagacacggccacacgagtaaccccagcgacgctttctccgcgcgtgtccgctccggcatcccggacactcctaccttgacagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagcgccccggaggtttctgggagtgcccgcccgcccgcgctcagtgcgcaggcgtcagacgctcagggcctgcgagagcgagctgagtggtcccagggtctacccctggcaggagagagggtgggacccgc

SEQ ID NO: 12586 - DNA, 1539 bp, Homo sapiens
gacctgtacatcgctcgaggggaacctgtcctgggctctggtgcacacatagtatgcgttctgggctggcttgggttgggccaggtaggggagacctggctgggtacgaggcgccgtccaagccttccggccgtgggccgggcggtcgcggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccaga

SEQ ID NO: 12587 - DNA, 782 bp, Artificial Sequence
  Description of Artificial Sequence: Synthetic polynucleotide
ttygtgtagtttttgtygyggttatttttattttygttttttyggtttttatttaygtttygagggtttttttgaattygaagatttttttgatgtttttagtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagagttttagttttttygggagttggaaayggagtttagtttgggggygtyggggttttttygttttyggygggagggggygtttttgygtggttyggaagygt

SEQ ID NO: 12588 - DNA, 615 bp, Artificial Sequence
  Description of Artificial Sequence: Synthetic polynucleotide
gyggttgyggtagggggtttyggggtygggatyggagyggygggygygattttygagtygggagttygggyggyggggttyggggtggtygtygttttttttttttgttgtagttttttgagtyggyggagggttatggtttyggygtyggaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygtgatatttggaggggtttgtgaagggatattgygtaaggtttgaaatttagggaygaatagttttggygatttatggagtggggtayggtaagaggttattgtaagaagtttggggagtyggggaggtagggagagttaygg

SEQ ID NO: 12589 - DNA, 763 bp, Artificial Sequence
  Description of Artificial Sequence: Synthetic polynucleotide
ttagtttygttaaggtttttttyggtggagttagygttgygatygtttgtagaaggttgattgygtggtagggggtttagagtaagtygaaggtaagtaygatggygtttattagtyggtttattygygtttygtgtygttyggagttttagygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygtygttagtagtaggaaggttgtgtttgtggttygygaagttttttagtttagtagtgtttygttttt

SEQ ID NO: 12590 - DNA, 1020 bp, Artificial Sequence
  Description of Artificial Sequence: Synthetic polynucleotide
atgatggttggtgggtagygggtygygyggagggtagyggygaggaagygttttyggyggggttygggttttgygygttggttggggygtygygttygygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgttagagaagttagggaygggygaygtttttttttttttataataagggttttttgagagtaggaagtagattttgttaggagtagaygttttygaaggaaggtgtgaaggaaggagttaggtagtgagtgagtagaaagggagttgttttaa

SEQ ID NO: 12591 - DNA, 608 bp, Artificial Sequence
  Description of Artificial Sequence: Synthetic polynucleotide
tatataygtttagtygtgtatgtataggtagtygttaatattaggtaggttgtagtttgtatataaaatyggagatayggttataygagtaattttagygaygtttttttygygygtgttygtttyggtatttyggatatttttattttgatagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagygtttyggaggtttttgggagtgttygttygttygygtttagtgygtaggygttagaygtttagggtttgygagagygagttgagtggttttagggtttatttttggtaggagagagggtgggattygt

SEQ ID NO: 12592 - DNA, 1539 bp, Artificial Sequence
  Description of Artificial Sequence: Synthetic polynucleotide
gatttgtatatygttygaggggaatttgttttgggttttggtgtatatatagtatgygttttgggttggtttgggttgggttaggtaggggagatttggttgggtaygaggygtygtttaagtttttyggtygtgggtygggyggtygyggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygttgygttttygtttttygtttttttagttttttttygtttttttttttygygtttggttyggygygtttyggtyggtygtaaagtttttygggyggtagyggyggttgygtttygttttagygatggtygyggagttgagtatggggttaga

SEQ ID NO: 12593 - DNA, 782 bp, Artificial Sequence
  Description of Artificial Sequence: Synthetic polynucleotide
ttcgtgtagtttttgtcgcggttatttttattttcgttttttcggtttttatttacgtttcgagggtttttttgaattcgaagatttttttgatgtttttagtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagagttttagttttttcgggagttggaaacggagtttagtttgggggcgtcggggttttttcgttttcggcgggagggggcgtttttgcgtggttcggaagcgt

SEQ ID NO: 12594 - DNA, 615 bp, Artificial Sequence
  Description of Artificial Sequence: Synthetic polynucleotide
gcggttgcggtagggggtttcggggtcgggatcggagcggcgggcgcgattttcgagtcgggagttcgggcggcggggttcggggtggtcgtcgttttttttttttgttgtagttttttgagtcggcggagggttatggtttcggcgtcggacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgtgatatttggaggggtttgtgaagggatattgcgtaaggtttgaaatttagggacgaatagttttggcgatttatggagtggggtacggtaagaggttattgtaagaagtttggggagtcggggaggtagggagagttacgg

SEQ ID NO: 12595 - DNA, 763 bp, Artificial Sequence
  Description of Artificial Sequence: Synthetic polynucleotide
ttagtttcgttaaggtttttttcggtggagttagcgttgcgatcgtttgtagaaggttgattgcgtggtagggggtttagagtaagtcgaaggtaagtacgatggcgtttattagtcggtttattcgcgtttcgtgtcgttcggagttttagcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgtcgttagtagtaggaaggttgtgtttgtggttcgcgaagttttttagtttagtagtgtttcgttttt

SEQ ID NO: 12596 - DNA, 1020 bp, Artificial Sequence
  Description of Artificial Sequence: Synthetic polynucleotide
atgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgtttttttttttttataataagggttttttgagagtaggaagtagattttgttaggagtagacgttttcgaaggaaggtgtgaaggaaggagttaggtagtgagtgagtagaaagggagttgttttaa

SEQ ID NO: 12597 - DNA, 608 bp, Artificial Sequence
  Description of Artificial Sequence: Synthetic polynucleotide
tatatacgtttagtcgtgtatgtataggtagtcgttaatattaggtaggttgtagtttgtatataaaatcggagatacggttatacgagtaattttagcgacgtttttttcgcgcgtgttcgtttcggtatttcggatatttttattttgatagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagcgtttcggaggtttttgggagtgttcgttcgttcgcgtttagtgcgtaggcgttagacgtttagggtttgcgagagcgagttgagtggttttagggtttatttttggtaggagagagggtgggattcgt

SEQ ID NO: 12598 - DNA, 1539 bp, Artificial Sequence
  Description of Artificial Sequence: Synthetic polynucleotide
gatttgtatatcgttcgaggggaatttgttttgggttttggtgtatatatagtatgcgttttgggttggtttgggttgggttaggtaggggagatttggttgggtacgaggcgtcgtttaagtttttcggtcgtgggtcgggcggtcgcggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgttgcgttttcgtttttcgtttttttagttttttttcgtttttttttttcgcgtttggttcggcgcgtttcggtcggtcgtaaagtttttcgggcggtagcggcggttgcgtttcgttttagcgatggtcgcggagttgagtatggggttaga

SEQ ID NO: 12599 - DNA, 262 bp, Homo sapiens
gaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaaga

SEQ ID NO: 12600 - DNA, 288 bp, Homo sapiens
aaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacc

SEQ ID NO: 12601 - DNA, 235 bp, Homo sapiens
gctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgacc

SEQ ID NO: 12602 - DNA, 273 bp, Homo sapiens
ctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcc

SEQ ID NO: 12603 - DNA, 257 bp, Homo sapiens
gctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacc

SEQ ID NO: 12604 - DNA, 254 bp, Homo sapiens
cctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggg

SEQ ID NO: 12605 - DNA, 262 bp, Artificial Sequence
  Description of Artificial Sequence: Synthetic polynucleotide
gaacagcagaaataagagccagggagggacygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaaga

SEQ ID NO: 12606 - DNA, 288 bp, Artificial Sequence
  Description of Artificial Sequence: Synthetic polynucleotide
aaattttgygtaatgtttttttatagatttttttaggtattaygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygatt

SEQ ID NO: 12607 - DNA, 235 bp, Artificial Sequence
  Description of Artificial Sequence: Synthetic polynucleotide
gtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatt

SEQ ID NO: 12608 - DNA, 273 bp, Artificial Sequence
  Description of Artificial Sequence: Synthetic polynucleotide
ttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttt

SEQ ID NO: 12609 - DNA, 257 bp, Artificial Sequence
  Description of Artificial Sequence: Synthetic polynucleotide
gttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatt

SEQ ID NO: 12610 - DNA, 254 bp, Artificial Sequence
  Description of Artificial Sequence: Synthetic polynucleotide
tttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggg

SEQ ID NO: 12611 - DNA, 262 bp, Artificial Sequence
  Description of Artificial Sequence: Synthetic polynucleotide
gaacagcagaaataagagccagggagggaccgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaaga

SEQ ID NO: 12612 - DNA, 288 bp, Artificial Sequence
  Description of Artificial Sequence: Synthetic polynucleotide
aaattttgcgtaatgtttttttatagatttttttaggtattacgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgatt

SEQ ID NO: 12613 - DNA, 235 bp, Artificial Sequence
  Description of Artificial Sequence: Synthetic polynucleotide
gtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatt

SEQ ID NO: 12614 - DNA, 273 bp, Artificial Sequence
  Description of Artificial Sequence: Synthetic polynucleotide
ttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttt

SEQ ID NO: 12615 - DNA, 257 bp, Artificial Sequence
  Description of Artificial Sequence: Synthetic polynucleotide
gttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatt

SEQ ID NO: 12616 - DNA, 254 bp, Artificial Sequence
  Description of Artificial Sequence: Synthetic polynucleotide
tttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggg

SEQ ID NO: 12617 - DNA, 261 bp, Homo sapiens
tcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgtt

SEQ ID NO: 12618 - DNA, 287 bp, Homo sapiens
ggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgtgatacctggaggggtctgtgaagggacattgcgcaaggtt

SEQ ID NO: 12619 - DNA, 235 bp, Homo sapiens
ggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagc

SEQ ID NO: 12620 - DNA, 273 bp, Homo sapiens
ggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggag

SEQ ID NO: 12621 - DNA, 257 bp, Homo sapiens
ggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagc

SEQ ID NO: 12622 - DNA, 254 bp, Homo sapiens
ccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcagg

SEQ ID NO: 12623 - DNA, 261 bp, Artificial Sequence
  Description of Artificial Sequence: Synthetic polynucleotide
tcttcttgatgtcttcagcttgctttttccaggaggagctgctctygcygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgtt

SEQ ID NO: 12624 - DNA, 287 bp, Artificial Sequence
  Description of Artificial Sequence: Synthetic polynucleotide
ggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygtgatatttggaggggtttgtgaagggatattgygtaaggtt

SEQ ID NO: 12625 - DNA, 235 bp, Artificial Sequence
  Description of Artificial Sequence: Synthetic polynucleotide
ggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagt

SEQ ID NO: 12626 - DNA, 273 bp, Artificial Sequence
  Description of Artificial Sequence: Synthetic polynucleotide
ggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggag

SEQ ID NO: 12627 - DNA, 257 bp, Artificial Sequence
  Description of Artificial Sequence: Synthetic polynucleotide
ggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagt

SEQ ID NO: 12628 - DNA, 254 bp, Artificial Sequence
  Description of Artificial Sequence: Synthetic polynucleotide
cccygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtagg

SEQ ID NO: 12629 - DNA, 261 bp, Artificial Sequence
  Description of Artificial Sequence: Synthetic polynucleotide
tcttcttgatgtcttcagcttgctttttccaggaggagctgctctcgccgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgtt

SEQ ID NO: 12630 - DNA, 287 bp, Artificial Sequence
  Description of Artificial Sequence: Synthetic polynucleotide
ggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgtgatatttggaggggtttgtgaagggatattgcgtaaggtt

SEQ ID NO: 12631 - DNA, 235 bp, Artificial Sequence
  Description of Artificial Sequence: Synthetic polynucleotide
ggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagt

SEQ ID NO: 12632 - DNA, 273 bp, Artificial Sequence
  Description of Artificial Sequence: Synthetic polynucleotide
ggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggag

SEQ ID NO: 12633 - DNA, 257 bp, Artificial Sequence
  Description of Artificial Sequence: Synthetic polynucleotide
ggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagt

SEQ ID NO: 12634 - DNA, 254 bp, Artificial Sequence
  Description of Artificial Sequence: Synthetic polynucleotide
ccccgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtagg

SEQ ID NO: 12635 - DNA, 30 bp, Artificial Sequence
  Description of Artificial Sequence: Synthetic primer
gaatagtagaaataagagttagggagggat

SEQ ID NO: 12636 - DNA, 37 bp, Artificial Sequence
  Description of Artificial Sequence: Synthetic primer
aaattttgygtaatgtttttttatagatttttttagg

SEQ ID NO: 12637 - DNA, 25 bp, Artificial Sequence
  Description of Artificial Sequence: Synthetic primer
gtttatyggtttgtttagtttgtag

SEQ ID NO: 12638 - DNA, 25 bp, Artificial Sequence
  Description of Artificial Sequence: Synthetic primer
ttttagggtttatttaggagggtgt

SEQ ID NO: 12639 - DNA, 29 bp, Artificial Sequence
  Description of Artificial Sequence: Synthetic primer
gttgtaggygggataagtaggttttatag

SEQ ID NO: 12640 - DNA, 30 bp, Artificial Sequence
  Description of Artificial Sequence: Synthetic primer
tttgtatygttttagagttttgggttgtgt

SEQ ID NO: 12641 - DNA, 35 bp, Artificial Sequence
  Description of Artificial Sequence: Synthetic primer
tcttcttaatatcttcaacttactttttccaaaaa

SEQ ID NO: 12642 - DNA, 23 bp, Artificial Sequence
  Description of Artificial Sequence: Synthetic primer
aatcrcctccctttataaactcc

SEQ ID NO: 12643 - DNA, 26 bp, Artificial Sequence
  Description of Artificial Sequence: Synthetic primer
aatcaaaatctccaaactcaaataaa

SEQ ID NO: 12644 - DNA, 33 bp, Artificial Sequence
  Description of Artificial Sequence: Synthetic primer
aaaaactatatttaaacaaccaaacaaaattct

SEQ ID NO: 12645 - DNA, 26 bp, Artificial Sequence
  Description of Artificial Sequence: Synthetic primer
aatacraaaccaaactcctccacaaa

SEQ ID NO: 12646 - DNA, 24 bp, Artificial Sequence
  Description of Artificial Sequence: Synthetic primer
cccrcaccccaataacatcaaaaa

SEQ ID NO: 12647 - DNA, 273 bp, Homo sapiens
ggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcct

SEQ ID NO: 12648 - DNA, 259 bp, Homo sapiens
ggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcg

SEQ ID NO: 12649 - DNA, 220 bp, Homo sapiens
gggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgc

SEQ ID NO: 12650 - DNA, 273 bp, Artificial Sequence
  Description of Artificial Sequence: Synthetic polynucleotide
ggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgttt

SEQ ID NO: 12651 - DNA, 259 bp, Artificial Sequence
  Description of Artificial Sequence: Synthetic polynucleotide
ggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagyg

SEQ ID NO: 12652 - DNA, 220 bp, Artificial Sequence
  Description of Artificial Sequence: Synthetic polynucleotide
gggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgy

SEQ ID NO: 12653 - DNA, 273 bp, Artificial Sequence
  Description of Artificial Sequence: Synthetic polynucleotide
ggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgttt

SEQ ID NO: 12654 - DNA, 259 bp, Artificial Sequence
  Description of Artificial Sequence: Synthetic polynucleotide
ggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcg

SEQ ID NO: 12655 - DNA, 220 bp, Artificial Sequence
  Description of Artificial Sequence: Synthetic polynucleotide
gggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgy

SEQ ID NO: 12656 - DNA, 272 bp, Homo sapiens
aggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgc

SEQ ID NO: 12657 - DNA, 259 bp, Homo sapiens
cgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgacc

SEQ ID NO: 12658 - DNA, 220 bp, Homo sapiens
gcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttccc

SEQ ID NO: 12659 - DNA, 272 bp, Artificial Sequence
  Description of Artificial Sequence: Synthetic polynucleotide
aggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygt

SEQ ID NO: 12660 - DNA, 259 bp, Artificial Sequence
  Description of Artificial Sequence: Synthetic polynucleotide
ygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatt

SEQ ID NO: 12661 - DNA, 220 bp, Artificial Sequence
  Description of Artificial Sequence: Synthetic polynucleotide
gtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttt

SEQ ID NO: 12662 - DNA, 272 bp, Artificial Sequence
  Description of Artificial Sequence: Synthetic polynucleotide
aggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgt

SEQ ID NO: 12663 - DNA, 259 bp, Artificial Sequence
  Description of Artificial Sequence: Synthetic polynucleotide
cgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatt

SEQ ID NO: 12664 - DNA, 220 bp, Artificial Sequence
  Description of Artificial Sequence: Synthetic polynucleotide
gtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttt

SEQ ID NO: 12665 - DNA, 24 bp, Artificial Sequence
  Description of Artificial Sequence: Synthetic primer
ggygttgttggggttgtttggtaa

SEQ ID NO: 12666 - DNA, 24 bp, Artificial Sequence
  Description of Artificial Sequence: Synthetic primer
ggtygtgtgtttaggattgttttt

SEQ ID NO: 12667 - DNA, 26 bp, Artificial Sequence
  Description of Artificial Sequence: Synthetic primer
gggaaaagtagtagtttaaaggtttt

SEQ ID NO: 12668 - DNA, 25 bp, Artificial Sequence
  Description of Artificial Sequence: Synthetic primer
aaacaacrctacaaactaaacaaac

SEQ ID NO: 12669 - DNA, 24 bp, Artificial Sequence
  Description of Artificial Sequence: Synthetic primer
crctcctacaatacaaaactaacc

SEQ ID NO: 12670 - DNA, 26 bp, Artificial Sequence
  Description of Artificial Sequence: Synthetic primer
acactttatacctatttaaacctctc

SEQ ID NO: 12671 - DNA, 2 bp, Homo sapiens
cg

SEQ ID NO: 12672 - DNA, 9 bp, Homo sapiens
cgaatggcg

SEQ ID NO: 12673 - DNA, 2 bp, Homo sapiens
cg

SEQ ID NO: 12674 - DNA, 2 bp, Homo sapiens
cg

SEQ ID NO: 12675 - DNA, 2 bp, Homo sapiens
cg

SEQ ID NO: 12676 - DNA, 2 bp, Homo sapiens
cg

SEQ ID NO: 12677 - DNA, 2 bp, Homo sapiens
cg

SEQ ID NO: 12678 - DNA, 2 bp, Homo sapiens
cg

SEQ ID NO: 12679 - DNA, 2 bp, Homo sapiens
cg

SEQ ID NO: 12680 - DNA, 2 bp, Homo sapiens
cg

SEQ ID NO: 12681 - DNA, 2 bp, Homo sapiens
cg

SEQ ID NO: 12682 - DNA, 2 bp, Homo sapiens
cg

SEQ ID NO: 12683 - DNA, 36 bp, Homo sapiens
cggctcacgcagggtgcgcgcacccactgacctgcg

SEQ ID NO: 12684 - DNA, 2 bp, Homo sapiens
cg

SEQ ID NO: 12685 - DNA, 2 bp, Homo sapiens
cg

SEQ ID NO: 12686 - DNA, 2 bp, Homo sapiens
cg

SEQ ID NO: 12687 - DNA, 2 bp, Homo sapiens
cg

SEQ ID NO: 12688 - DNA, 2 bp, Homo sapiens
cg

SEQ ID NO: 12689 - DNA, 2 bp, Homo sapiens
cg

SEQ ID NO: 12690 - DNA, 2 bp, Homo sapiens
cg

SEQ ID NO: 12691 - DNA, 2 bp, Homo sapiens
cg

SEQ ID NO: 12692 - DNA, 2 bp, Homo sapiens
cg

SEQ ID NO: 12693 - DNA, 2 bp, Homo sapiens
cg

SEQ ID NO: 12694 - DNA, 8 bp, Homo sapiens
cgacggcg

SEQ ID NO: 12695 - DNA, 2 bp, Homo sapiens
cg

SEQ ID NO: 12696 - DNA, 2 bp, Homo sapiens
cg

SEQ ID NO: 12697 - DNA, 2 bp, Homo sapiens
cg

SEQ ID NO: 12698 - DNA, 2 bp, Homo sapiens
cg

SEQ ID NO: 12699 - DNA, 2 bp, Homo sapiens
cg

SEQ ID NO: 12700 - DNA, 2 bp, Homo sapiens
cg

SEQ ID NO: 12701 - DNA, 2 bp, Homo sapiens
cg

SEQ ID NO: 12702 - DNA, 2 bp, Homo sapiens
cg

SEQ ID NO: 12703 - DNA, 2 bp, Homo sapiens
cg

SEQ ID NO: 12704 - DNA, 2 bp, Homo sapiens
cg

SEQ ID NO: 12705 - DNA, 181 bp, Homo sapiens
cggagattgcagtgagccgagatcgtgccattgcactccaatggcactccagcctgatgacagagcgagactccgtctcaaaaataataataaataaataaacaaacaaacaaaaattagctgggcgtggtggcgtgtgcctgtagtcccagctactcgggagactgaggcaggagaatcg

SEQ ID NO: 12706 - DNA, 2 bp, Homo sapiens
cg

SEQ ID NO: 12707 - DNA, 2 bp, Homo sapiens
cg

SEQ ID NO: 12708 - DNA, 2 bp, Homo sapiens
cg

SEQ ID NO: 12709 - DNA, 2 bp, Homo sapiens
cg

SEQ ID NO: 12710 - DNA, 2 bp, Homo sapiens
cg

SEQ ID NO: 12711 - DNA, 2 bp, Homo sapiens
cg

SEQ ID NO: 12712 - DNA, 2 bp, Homo sapiens
cg

SEQ ID NO: 12713 - DNA, 2 bp, Homo sapiens
cg

SEQ ID NO: 12714 - DNA, 2 bp, Homo sapiens
cg

SEQ ID NO: 12715 - DNA, 2 bp, Homo sapiens
cg

SEQ ID NO: 12716 - DNA, 369 bp, Homo sapiens
cgcgtttgaggagcccttcagcccgtcgctgcactgtgggagcccctttctgggctggacaaggctggagccggctccctcagcttgcgggtaggtgtggagagagaggcgtgggcgggaaccgtggctgcaggctgcgcttgcgggccagctcgagttccgggtgggcgtgggcttggcaagccccgcactcggagcggccagccggcccgggcagtgaggagcttagcacctgggccagcagctgctgtgctcgacttctcgctgggccttagctgcctccccgccgggcagggctcgggacctgcagccctccatgcctgagcctccacccccgccgtgcgctcctgtgcagcccaagcctccccg

SEQ ID NO: 12717 - DNA, 2 bp, Homo sapiens
cg

SEQ ID NO: 12718 - DNA, 2 bp, Homo sapiens
cg

SEQ ID NO: 12719 - DNA, 2 bp, Homo sapiens
cg

SEQ ID NO: 12720 - DNA, 2 bp, Homo sapiens
cg

SEQ ID NO: 12721 - DNA, 2 bp, Homo sapiens
cg

SEQ ID NO: 12722 - DNA, 2 bp, Homo sapiens
cg

SEQ ID NO: 12723 - DNA, 2 bp, Homo sapiens
cg

SEQ ID NO: 12724 - DNA, 2 bp, Homo sapiens
cg

SEQ ID NO: 12725 - DNA, 2 bp, Homo sapiens
cg

SEQ ID NO: 12726 - DNA, 2 bp, Homo sapiens
cg

SEQ ID NO: 12727 - DNA, 2 bp, Homo sapiens
cg

SEQ ID NO: 12728 - DNA, 2 bp, Homo sapiens
cg

SEQ ID NO: 12729 - DNA, 2 bp, Homo sapiens
cg

SEQ ID NO: 12730 - DNA, 2 bp, Homo sapiens
cg

SEQ ID NO: 12731 - DNA, 2 bp, Homo sapiens
cg

SEQ ID NO: 12732 - DNA, 2 bp, Homo sapiens
cg

SEQ ID NO: 12733 - DNA, 2 bp, Homo sapiens
cg

SEQ ID NO: 12734 - DNA, 2 bp, Homo sapiens
cg

SEQ ID NO: 12735 - DNA, 2 bp, Homo sapiens
cg

SEQ ID NO: 12736 - DNA, 2 bp, Homo sapiens
cg

SEQ ID NO: 12737 - DNA, 2 bp, Homo sapiens
cg

SEQ ID NO: 12738 - DNA, 35 bp, Homo sapiens
cgcttgcaccactacctcgacttcatttactaccg

SEQ ID NO: 12739 - DNA, 2 bp, Homo sapiens
cg

SEQ ID NO: 12740 - DNA, 2 bp, Homo sapiens
cg

SEQ ID NO: 12741 - DNA, 2 bp, Homo sapiens
cg

SEQ ID NO: 12742 - DNA, 2 bp, Homo sapiens
cg

SEQ ID NO: 12743 - DNA, 2 bp, Homo sapiens
cg

SEQ ID NO: 12744 - DNA, 2 bp, Homo sapiens
cg

SEQ ID NO: 12745 - DNA, 2 bp, Homo sapiens
cg

SEQ ID NO: 12746 - DNA, 2 bp, Homo sapiens
cg

SEQ ID NO: 12747 - DNA, 2 bp, Homo sapiens
cg

SEQ ID NO: 12748 - DNA, 2 bp, Homo sapiens
cg

SEQ ID NO: 12749 - DNA, 487 bp, Homo sapiens
cgcccagggcgggaatccagcgcacgggtgaggactttaaaaagcaaggggcaggatgagtcaacaaggttttgagcaggaaaactatgcgataggaagtgtatacattgccctatagcagaaagaccggggacgggaccagcctccaagcgacttcaaacccaaaaggaagcaacttccagactcttatgggcgtctcaatttgctctgggtgaaggaagacaggcaagaatttccaggtctgtgaggaccccacgtcccagggacagaagtgccagggacctgggaagtgcagacttaatacaaggcagagcaaaactcacgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcg

SEQ ID NO: 12750 - DNA, 2 bp, Homo sapiens
cg

SEQ ID NO: 12751 - DNA, 2 bp, Homo sapiens
cg

SEQ ID NO: 12752 - DNA, 2 bp, Homo sapiens
cg

SEQ ID NO: 12753 - DNA, 2 bp, Homo sapiens
cg

SEQ ID NO: 12754 - DNA, 2 bp, Homo sapiens
cg

SEQ ID NO: 12755 - DNA, 2 bp, Homo sapiens
cg

SEQ ID NO: 12756 - DNA, 2 bp, Homo sapiens
cg

SEQ ID NO: 12757 - DNA, 2 bp, Homo sapiens
cg

SEQ ID NO: 12758 - DNA, 2 bp, Homo sapiens
cg

SEQ ID NO: 12759 - DNA, 2 bp, Homo sapiens
cg

SEQ ID NO: 12760 - DNA, 28 bp, Homo sapiens
cgtcttgatctcctgacctcgtgatccg

SEQ ID NO: 12761 - DNA, 2 bp, Homo sapiens
cg

SEQ ID NO: 12762 - DNA, 2 bp, Homo sapiens
cg

SEQ ID NO: 12763 - DNA, 2 bp, Homo sapiens
cg

SEQ ID NO: 12764 - DNA, 2 bp, Homo sapiens
cg

SEQ ID NO: 12765 - DNA, 2 bp, Homo sapiens
cg

SEQ ID NO: 12766 - DNA, 2 bp, Homo sapiens
cg

SEQ ID NO: 12767 - DNA, 2 bp, Homo sapiens
cg

SEQ ID NO: 12768 - DNA, 2 bp, Homo sapiens
cg

SEQ ID NO: 12769 - DNA, 2 bp, Homo sapiens
cg

SEQ ID NO: 12770 - DNA, 2 bp, Homo sapiens
cg

SEQ ID NO: 12771 - DNA, 2 bp, Homo sapiens
cg

SEQ ID NO: 12772 - DNA, 2 bp, Homo sapiens
cg

SEQ ID NO: 12773 - DNA, 2 bp, Homo sapiens
cg

SEQ ID NO: 12774 - DNA, 2 bp, Homo sapiens
cg

SEQ ID NO: 12775 - DNA, 2 bp, Homo sapiens
cg

SEQ ID NO: 12776 - DNA, 2 bp, Homo sapiens
cg

SEQ ID NO: 12777 - DNA, 2 bp, Homo sapiens
cg

SEQ ID NO: 12778 - DNA, 2 bp, Homo sapiens
cg

SEQ ID NO: 12779 - DNA, 2 bp, Homo sapiens
cg

SEQ ID NO: 12780 - DNA, 2 bp, Homo sapiens
cg

SEQ ID NO: 12781 - DNA, 2 bp, Homo sapiens
cg

SEQ ID NO: 12782 - DNA, 18 bp, Homo sapiens
cgcgccttcctgaccgcg

SEQ ID NO: 12783 - DNA, 18 bp, Homo sapiens
cgcaggtcagtgagtgcg

SEQ ID NO: 12784 - DNA, 2 bp, Homo sapiens
cg

SEQ ID NO: 12785 - DNA, 2 bp, Homo sapiens
cg

SEQ ID NO: 12786 - DNA, 2 bp, Homo sapiens
cg

SEQ ID NO: 12787 - DNA, 2 bp, Homo sapiens
cg

SEQ ID NO: 12788 - DNA, 2 bp, Homo sapiens
cg

SEQ ID NO: 12789 - DNA, 2 bp, Homo sapiens
cg

SEQ ID NO: 12790 - DNA, 2 bp, Homo sapiens
cg

SEQ ID NO: 12791 - DNA, 2 bp, Homo sapiens
cg

SEQ ID NO: 12792 - DNA, 2 bp, Homo sapiens
cg

SEQ ID NO: 12793 - DNA, 2 bp, Homo sapiens
cg

SEQ ID NO: 12794 - DNA, 87 bp, Homo sapiens
cgagccgaagcagggcgaggcattgcctcacctgggaagcgcaaggggtcagagagttccctttccgagtcaaataaatgggtgacg

SEQ ID NO: 12795 - DNA, 2 bp, Homo sapiens
cg

SEQ ID NO: 12796 - DNA, 2 bp, Homo sapiens
cg

SEQ ID NO: 12797 - DNA, 2 bp, Homo sapiens
cg

SEQ ID NO: 12798 - DNA, 2 bp, Homo sapiens
cg

SEQ ID NO: 12799 - DNA, 2 bp, Homo sapiens
cg

SEQ ID NO: 12800 - DNA, 2 bp, Homo sapiens
cg

SEQ ID NO: 12801 - DNA, 2 bp, Homo sapiens
cg

SEQ ID NO: 12802 - DNA, 2 bp, Homo sapiens
cg

SEQ ID NO: 12803 - DNA, 2 bp, Homo sapiens
cg

SEQ ID NO: 12804 - DNA, 2 bp, Homo sapiens
cg

SEQ ID NO: 12805 - DNA, 11 bp, Homo sapiens
cggagcttgcg

SEQ ID NO: 12806 - DNA, 2 bp, Homo sapiens
cg

SEQ ID NO: 12807 - DNA, 2 bp, Homo sapiens
cg

SEQ ID NO: 12808 - DNA, 2 bp, Homo sapiens
cg

SEQ ID NO: 12809 - DNA, 2 bp, Homo sapiens
cg

SEQ ID NO: 12810 - DNA, 2 bp, Homo sapiens
cg

SEQ ID NO: 12811 - DNA, 2 bp, Homo sapiens
cg

SEQ ID NO: 12812 - DNA, 2 bp, Homo sapiens
cg

SEQ ID NO: 12813 - DNA, 2 bp, Homo sapiens
cg

SEQ ID NO: 12814 - DNA, 2 bp, Homo sapiens
cg

SEQ ID NO: 12815 - DNA, 2 bp, Homo sapiens
cg

SEQ ID NO: 12816 - DNA, 2 bp, Homo sapiens
cg

SEQ ID NO: 12817 - DNA, 2 bp, Homo sapiens
cg

SEQ ID NO: 12818 - DNA, 2 bp, Homo sapiens
cg

SEQ ID NO: 12819 - DNA, 2 bp, Homo sapiens
cg

SEQ ID NO: 12820 - DNA, 2 bp, Homo sapiens
cg

SEQ ID NO: 12821 - DNA, 2 bp, Homo sapiens
cg

SEQ ID NO: 12822 - DNA, 2 bp, Homo sapiens
cg

SEQ ID NO: 12823 - DNA, 2 bp, Homo sapiens
cg

SEQ ID NO: 12824 - DNA, 2 bp, Homo sapiens
cg

SEQ ID NO: 12825 - DNA, 167 bp, Homo sapiens
cgcaccgtgggcgagccgaagcagggcgaggcattgcctcacctgggaagcgccaggggtcagggagttccctttccgagtcaaggaaaggggtgaccgacgcacctagaaaatcgggtcactcccacccgaatattgcgcttttcagaccggcttaaaaaatggcg

SEQ ID NO: 12826 - DNA, 2 bp, Homo sapiens
cg

SEQ ID NO: 12827 - DNA, 2 bp, Homo sapiens
cg

SEQ ID NO: 12828 - DNA, 2 bp, Homo sapiens
cg

SEQ ID NO: 12829 - DNA, 185 bp, Homo sapiens
cgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccg

SEQ ID NO: 12830 - DNA, 17 bp, Homo sapiens
cgagccgaagcagggcg

SEQ ID NO: 12831 - DNA, 135 bp, Homo sapiens
cgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcg

SEQ ID NO: 12832 - DNA, 2 bp, Homo sapiens
cg

SEQ ID NO: 12833 - DNA, 71 bp, Homo sapiens
cgctcgctcttggcgcctcctcggccttggcacccactctggccgcgcttgaggagcccttcagcccgccg

SEQ ID NO: 12834 - DNA, 54 bp, Homo sapiens
cgcgcaccgtgcgcgagccgaagcagggcgaggcattgcctcacttgggaagcg

SEQ ID NO: 12835 - DNA, 5 bp, Homo sapiens
cggcg

SEQ ID NO: 12836 - DNA, 29 bp, Homo sapiens
cgccggtttttaagcccgtaggaaaagcg

SEQ ID NO: 12837 - DNA, 18 bp, Homo sapiens
cgctttctagtgtctgcg

SEQ ID NO: 12838 - DNA, 2 bp, Homo sapiens
cg

SEQ ID NO: 12839 - DNA, 5 bp, Homo sapiens
cgacg

SEQ ID NO: 12840 - DNA, 24 bp, Homo sapiens
cgaagcgcctcctgcgcagactcg

SEQ ID NO: 12841 - DNA, 2 bp, Homo sapiens
cg

SEQ ID NO: 12842 - DNA, 4 bp, Homo sapiens
cgcg

SEQ ID NO: 12843 - DNA, 2 bp, Homo sapiens
cg

SEQ ID NO: 12844 - DNA, 2 bp, Homo sapiens
cg

SEQ ID NO: 12845 - DNA, 2 bp, Homo sapiens
cg

SEQ ID NO: 12846 - DNA, 2 bp, Homo sapiens
cg

SEQ ID NO: 12847 - DNA, 2 bp, Homo sapiens
cg

SEQ ID NO: 12848 - DNA, 2 bp, Homo sapiens
cg

SEQ ID NO: 12849 - DNA, 2 bp, Homo sapiens
cg

SEQ ID NO: 12850 - DNA, 2 bp, Homo sapiens
cg

SEQ ID NO: 12851 - DNA, 2 bp, Homo sapiens
cg

SEQ ID NO: 12852 - DNA, 2 bp, Homo sapiens
cg

SEQ ID NO: 12853 - DNA, 12 bp, Homo sapiens
cggggcaggtcg

SEQ ID NO: 12854 - DNA, 2 bp, Homo sapiens
cg

SEQ ID NO: 12855 - DNA, 2 bp, Homo sapiens
cg

SEQ ID NO: 12856 - DNA, 2 bp, Homo sapiens
cg

SEQ ID NO: 12857 - DNA, 2 bp, Homo sapiens
cg

SEQ ID NO: 12858 - DNA, 2 bp, Homo sapiens
cg

SEQ ID NO: 12859 - DNA, 2 bp, Homo sapiens
cg

SEQ ID NO: 12860 - DNA, 2 bp, Homo sapiens
cg

SEQ ID NO: 12861 - DNA, 2 bp, Homo sapiens
cg

SEQ ID NO: 12862 - DNA, 2 bp, Homo sapiens
cg

SEQ ID NO: 12863 - DNA, 2 bp, Homo sapiens
cg

SEQ ID NO: 12864 - DNA, 2 bp, Homo sapiens
cg

SEQ ID NO: 12865 - DNA, 2 bp, Homo sapiens
cg

SEQ ID NO: 12866 - DNA, 2 bp, Homo sapiens
cg

SEQ ID NO: 12867 - DNA, 2 bp, Homo sapiens
cg

SEQ ID NO: 12868 - DNA, 2 bp, Homo sapiens
cg

SEQ ID NO: 12869 - DNA, 2 bp, Homo sapiens
cg

SEQ ID NO: 12870 - DNA, 2 bp, Homo sapiens
cg

SEQ ID NO: 12871 - DNA, 2 bp, Homo sapiens
cg

SEQ ID NO: 12872 - DNA, 2 bp, Homo sapiens
cg

SEQ ID NO: 12873 - DNA, 2 bp, Homo sapiens
cg

SEQ ID NO: 12874 - DNA, 2 bp, Homo sapiens
cg

SEQ ID NO: 12875 - DNA, 80 bp, Homo sapiens
cgtactcgcgccaggagtatggactcacccagggagtgcttgggcggagaagcagcctctgctccaggccttccgctgcg

SEQ ID NO: 12876 - DNA, 2 bp, Homo sapiens
cg

SEQ ID NO: 12877 - DNA, 2 bp, Homo sapiens
cg

SEQ ID NO: 12878 - DNA, 2 bp, Homo sapiens
cg

SEQ ID NO: 12879 - DNA, 2 bp, Homo sapiens
cg

SEQ ID NO: 12880 - DNA, 2 bp, Homo sapiens
cg

SEQ ID NO: 12881 - DNA, 2 bp, Homo sapiens
cg

SEQ ID NO: 12882 - DNA, 2 bp, Homo sapiens
cg

SEQ ID NO: 12883 - DNA, 2 bp, Homo sapiens
cg

SEQ ID NO: 12884 - DNA, 2 bp, Homo sapiens
cg

SEQ ID NO: 12885 - DNA, 2 bp, Homo sapiens
cg

SEQ ID NO: 12886 - DNA, 4 bp, Homo sapiens
cgcg

SEQ ID NO: 12887 - DNA, 2 bp, Homo sapiens
cg

SEQ ID NO: 12888 - DNA, 2 bp, Homo sapiens
cg

SEQ ID NO: 12889 - DNA, 2 bp, Homo sapiens
cg

SEQ ID NO: 12890 - DNA, 2 bp, Homo sapiens
cg

SEQ ID NO: 12891 - DNA, 2 bp, Homo sapiens
cg

SEQ ID NO: 12892 - DNA, 2 bp, Homo sapiens
cg

SEQ ID NO: 12893 - DNA, 2 bp, Homo sapiens
cg

SEQ ID NO: 12894 - DNA, 2 bp, Homo sapiens
cg

SEQ ID NO: 12895 - DNA, 2 bp, Homo sapiens
cg

SEQ ID NO: 12896 - DNA, 2 bp, Homo sapiens
cg

SEQ ID NO: 12897 - DNA, 3039 bp, Homo sapiens
cgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgccaggcccgagggggttgttgtgtcccaggcttgcacccagggttccacggggggcaccccaaagcggcaagtaggttcccaggggaaggggacagcacgtcaggcttggagggggacgttgaggcagccccgggaataaagaggggatgctggggtcctgccacggataacactgtcttcccgacagcatctgtggtgggcctgggagcgtcatggagtccttggcttgcacccaaggtgcgtgtctcgccctcggggggcaccacaaagcggcaagaaggccaccgggggaagggtatgggacgccagggttgaaagggatagttgaggcagtccggggaaaaacgtggcaggctggggtcgtcccatggacgacagtgccttcccagcagcccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtggagtccctatcttgcacccagggtgcgtgtttcgcccatgggaggcaccccaaagcggcaagtaggcccctgggggaaggggacagcacctcagacttgaagggggactttgaggtagcccgtggaaaaaaacggcgacgctgagtttctcccacaaacgacagtgccttcctggcagccccttcgctgggccagggtggtcctggagtccgtggcttgcacccagggtgcgtgtctcgctcaagggggcaccccaaagcggcaagtagattcccgggggaagggagagcacgtcaggcttgaaggggaggttgaggcggccccggggtaaaagtggtgaagctggggtcctcccacggatgacaccgccttcctggcagcctctgcagtgggcccagaggtgtcgtggagtctctggcttgctcccaggttgtgtgtctcgcccacgagtggcaccacaaagcagcaagaaggcccccaggggaagggtacaggactccagggttgaaaggtagagttgaggcagaccggtgtcatcccaaggacaacagtgtcttgtccggtagcccctgcatcgggcctggggtggttgtggagtccctggcttgcacccggggtgcgtgtcgtgcccacgatgggcaccgcaatgcggtaagaagtccccgagtggaagggaacaggacgccgagcttgaaaggggacgttgaggcagtccggggaaaaaatttccactgagaacagtgccttcccggcagcctctgagtgggacccaggtggacggtggagcccctggcttggacccagggtgcctgtcttgctcacggggtgcacgtgaaagtggcaacagggcccccgggggaaggggacaacatgtcaggcttgaagagggacgttgggccagccagaggaaaacagcggctaggctgtggtcgtcccacagaccacagtgccttcccggcagcccctgagcctggcccaggcgggggggtttggagtccctgtcttgcaacagagtgcgtgtctcgcctaagtgtgcacgcgaaagctgcaagaagggctccgggggaagggaacaggatgccaggcttgaaaggggactttgaggcagtccagggaaaaactttccacggaggacagtgacttcccgacatcccctgcgcctggccctgggggtcttggagtccctggtttacacccagggtgcgtgcctcgcccacgggtggcaccccaaagcagcaagaaagccccggggggggaagaacaggatgccagacttgaaaggggacgttgaggcagcccaggaaaaaaaggggcgaggctggggtcctttcacggatgacagtgccttccctacagcccctatgccagtcccgggagggtcgcggagtccctgtcttgcacacaatgtgcgtgtctcgcccacggggggcaccccaaagtggcaagaagtcccccgcgggaaggcaacaggacgccaggcttgaatggggacgtttaggtagcctggagaaaaaagcagcgaggctggggtgatcccacgaatgacagtgccttaccggcagcccctttgccgggcatgcgggggttgttgattccctggcttgcacccagggtgagtgtcttgcccacggcgggcaccacaaagcagcaagaaggttcccgggggaaagggacagcacgtcagtcttgaagggggaagttgaggcagccccggggaaaaaaagcggggatgctggggtcctctcacggacgacactgccttcccagcagcctctgcagtgggcccgggagcgtcctggagtccctgtcttgcaccccgggtgcgtgtctcacccacggggagcaccacaaagcggcaagaaggccactgggggaagggtacaggacgccagggttgaaggggatagtggagacagtccaaggaaaaaagtggcgggatggtgtcgtcccaaggatggccacccctgcgccgggccagggatggtcgcggagtccctggcttgcacccaggttgtgtgtctcgcccacagggggcaccccaaagcagcacgaaggcctccaggggaagggaagaggacgccaggcttggaaggtgacgttgaggcagcagggggtaaaaagtggcgggccgggccctcccacggatgacagtgccttcccggaagccgctgcgcagggcccggcgtgtttgtggagtctctggcttgcacccagaatcgtgcg

SEQ ID NO: 12898 - DNA, 2 bp, Homo sapiens
cg

SEQ ID NO: 12899 - DNA, 2 bp, Homo sapiens
cg

SEQ ID NO: 12900 - DNA, 2 bp, Homo sapiens
cg

SEQ ID NO: 12901 - DNA, 2 bp, Homo sapiens
cg

SEQ ID NO: 12902 - DNA, 2 bp, Homo sapiens
cg

SEQ ID NO: 12903 - DNA, 2 bp, Homo sapiens
cg

SEQ ID NO: 12904 - DNA, 2 bp, Homo sapiens
cg

SEQ ID NO: 12905 - DNA, 2 bp, Homo sapiens
cg

SEQ ID NO: 12906 - DNA, 2 bp, Homo sapiens
cg

SEQ ID NO: 12907 - DNA, 2 bp, Homo sapiens
cg

SEQ ID NO: 12908 - DNA, 2 bp, Homo sapiens
cg

SEQ ID NO: 12909 - DNA, 9 bp, Homo sapiens
cgccattcg

SEQ ID NO: 12910 - DNA, 2 bp, Homo sapiens
cg

SEQ ID NO: 12911 - DNA, 2 bp, Homo sapiens
cg

SEQ ID NO: 12912 - DNA, 2 bp, Homo sapiens
cg

SEQ ID NO: 12913 - DNA, 2 bp, Homo sapiens
cg

SEQ ID NO: 12914 - DNA, 2 bp, Homo sapiens
cg

SEQ ID NO: 12915 - DNA, 2 bp, Homo sapiens
cg

SEQ ID NO: 12916 - DNA, 2 bp, Homo sapiens
cg

SEQ ID NO: 12917 - DNA, 2 bp, Homo sapiens
cg

SEQ ID NO: 12918 - DNA, 2 bp, Homo sapiens
cg

SEQ ID NO: 12919 - DNA, 2 bp, Homo sapiens
cg

SEQ ID NO: 12920 - DNA, 36 bp, Homo sapiens
cgcaggtcagtgggtgcgcgcaccctgcgtgagccg

SEQ ID NO: 12921 - DNA, 2 bp, Homo sapiens
cg

SEQ ID NO: 12922 - DNA, 2 bp, Homo sapiens
cg

SEQ ID NO: 12923 - DNA, 2 bp, Homo sapiens
cg

SEQ ID NO: 12924 - DNA, 2 bp, Homo sapiens
cg

SEQ ID NO: 12925 - DNA, 2 bp, Homo sapiens
cg

SEQ ID NO: 12926 - DNA, 2 bp, Homo sapiens
cg

SEQ ID NO: 12927 - DNA, 2 bp, Homo sapiens
cg

SEQ ID NO: 12928 - DNA, 2 bp, Homo sapiens
cg

SEQ ID NO: 12929 - DNA, 2 bp, Homo sapiens
cg

SEQ ID NO: 12930 - DNA, 2 bp, Homo sapiens
cg

SEQ ID NO: 12931 - DNA, 8 bp, Homo sapiens
cgccgtcg

SEQ ID NO: 12932 - DNA, 2 bp, Homo sapiens
cg

SEQ ID NO: 12933 - DNA, 2 bp, Homo sapiens
cg

SEQ ID NO: 12934 - DNA, 2 bp, Homo sapiens
cg

SEQ ID NO: 12935 - DNA, 2 bp, Homo sapiens
cg

SEQ ID NO: 12936 - DNA, 2 bp, Homo sapiens
cg

SEQ ID NO: 12937 - DNA, 2 bp, Homo sapiens
cg

SEQ ID NO: 12938 - DNA, 2 bp, Homo sapiens
cg

SEQ ID NO: 12939 - DNA, 2 bp, Homo sapiens
cg

SEQ ID NO: 12940 - DNA, 2 bp, Homo sapiens
cg

SEQ ID NO: 12941 - DNA, 2 bp, Homo sapiens
cg

SEQ ID NO: 12942 - DNA, 181 bp, Homo sapiens
cgattctcctgcctcagtctcccgagtagctgggactacaggcacacgccaccacgcccagctaatttttgtttgtttgtttatttatttattattatttttgagacggagtctcgctctgtcatcaggctggagtgccattggagtgcaatggcacgatctcggctcactgcaatctccg

SEQ ID NO: 12943 - DNA, 2 bp, Homo sapiens
cg

SEQ ID NO: 12944 - DNA, 2 bp, Homo sapiens
cg

SEQ ID NO: 12945 - DNA, 2 bp, Homo sapiens
cg

SEQ ID NO: 12946 - DNA, 2 bp, Homo sapiens
cg

SEQ ID NO: 12947 - DNA, 2 bp, Homo sapiens
cg

SEQ ID NO: 12948 - DNA, 2 bp, Homo sapiens
cg

SEQ ID NO: 12949 - DNA, 2 bp, Homo sapiens
cg

SEQ ID NO: 12950 - DNA, 2 bp, Homo sapiens
cg

SEQ ID NO: 12951 - DNA, 2 bp, Homo sapiens
cg

SEQ ID NO: 12952 - DNA, 2 bp, Homo sapiens
cg

SEQ ID NO: 12953 - DNA, 369 bp, Homo sapiens
cggggaggcttgggctgcacaggagcgcacggcgggggtggaggctcaggcatggagggctgcaggtcccgagccctgcccggcggggaggcagctaaggcccagcgagaagtcgagcacagcagctgctggcccaggtgctaagctcctcactgcccgggccggctggccgctccgagtgcggggcttgccaagcccacgcccacccggaactcgagctggcccgcaagcgcagcctgcagccacggttcccgcccacgcctctctctccacacctacccgcaagctgagggagccggctccagccttgtccagcccagaaaggggctcccacagtgcagcgacgggctgaagggctcctcaaacgcg

SEQ ID NO: 12954 - DNA, 2 bp, Homo sapiens
cg

SEQ ID NO: 12955 - DNA, 2 bp, Homo sapiens
cg

SEQ ID NO: 12956 - DNA, 2 bp, Homo sapiens
cg

SEQ ID NO: 12957 - DNA, 2 bp, Homo sapiens
cg

SEQ ID NO: 12958 - DNA, 2 bp, Homo sapiens
cg

SEQ ID NO: 12959 - DNA, 2 bp, Homo sapiens
cg

SEQ ID NO: 12960 - DNA, 2 bp, Homo sapiens
cg

SEQ ID NO: 12961 - DNA, 2 bp, Homo sapiens
cg

SEQ ID NO: 12962 - DNA, 2 bp, Homo sapiens
cg

SEQ ID NO: 12963 - DNA, 2 bp, Homo sapiens
cg

SEQ ID NO: 12964 - DNA, 2 bp, Homo sapiens
cg

SEQ ID NO: 12965 - DNA, 2 bp, Homo sapiens
cg

SEQ ID NO: 12966 - DNA, 2 bp, Homo sapiens
cg

SEQ ID NO: 12967 - DNA, 2 bp, Homo sapiens
cg

SEQ ID NO: 12968 - DNA, 2 bp, Homo sapiens
cg

SEQ ID NO: 12969 - DNA, 2 bp, Homo sapiens
cg

SEQ ID NO: 12970 - DNA, 2 bp, Homo sapiens
cg

SEQ ID NO: 12971 - DNA, 2 bp, Homo sapiens
cg

SEQ ID NO: 12972 - DNA, 2 bp, Homo sapiens
cg

SEQ ID NO: 12973 - DNA, 2 bp, Homo sapiens
cg

SEQ ID NO: 12974 - DNA, 2 bp, Homo sapiens
cg

SEQ ID NO: 12975 - DNA, 35 bp, Homo sapiens
cggtagtaaatgaagtcgaggtagtggtgcaagcg

SEQ ID NO: 12976 - DNA, 2 bp, Homo sapiens
cg

SEQ ID NO: 12977 - DNA, 2 bp, Homo sapiens
cg

SEQ ID NO: 12978 - DNA, 2 bp, Homo sapiens
cg

SEQ ID NO: 12979 - DNA, 2 bp, Homo sapiens
cg

SEQ ID NO: 12980 - DNA, 2 bp, Homo sapiens
cg

SEQ ID NO: 12981 - DNA, 2 bp, Homo sapiens
cg

SEQ ID NO: 12982 - DNA, 2 bp, Homo sapiens
cg

SEQ ID NO: 12983 - DNA, 2 bp, Homo sapiens
cg

SEQ ID NO: 12984 - DNA, 2 bp, Homo sapiens
cg

SEQ ID NO: 12985 - DNA, 2 bp, Homo sapiens
cg

SEQ ID NO: 12986 - DNA, 487 bp, Homo sapiens
cgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgtgagttttgctctgccttgtattaagtctgcacttcccaggtccctggcacttctgtccctgggacgtggggtcctcacagacctggaaattcttgcctgtcttccttcacccagagcaaattgagacgcccataagagtctggaagttgcttccttttgggtttgaagtcgcttggaggctggtcccgtccccggtctttctgctatagggcaatgtatacacttcctatcgcatagttttcctgctcaaaaccttgttgactcatcctgccccttgctttttaaagtcctcacccgtgcgctggattcccgccctgggcg

SEQ ID NO: 12987 - DNA, 2 bp, Homo sapiens
cg

SEQ ID NO: 12988 - DNA, 2 bp, Homo sapiens
cg

SEQ ID NO: 12989 - DNA, 2 bp, Homo sapiens
cg

SEQ ID NO: 12990 - DNA, 2 bp, Homo sapiens
cg

SEQ ID NO: 12991 - DNA, 2 bp, Homo sapiens
cg

SEQ ID NO: 12992 - DNA, 2 bp, Homo sapiens
cg

SEQ ID NO: 12993 - DNA, 2 bp, Homo sapiens
cg

SEQ ID NO: 12994 - DNA, 2 bp, Homo sapiens
cg

SEQ ID NO: 12995 - DNA, 2 bp, Homo sapiens
cg

SEQ ID NO: 12996 - DNA, 2 bp, Homo sapiens
cg

SEQ ID NO: 12997 - DNA, 28 bp, Homo sapiens
cggatcacgaggtcaggagatcaagacg

SEQ ID NO: 12998 - DNA, 2 bp, Homo sapiens
cg

SEQ ID NO: 12999 - DNA, 2 bp, Homo sapiens
cg

SEQ ID NO: 13000 - DNA, 2 bp, Homo sapiens
cg

SEQ ID NO: 13001 - DNA, 2 bp, Homo sapiens
cg

SEQ ID NO: 13002 - DNA, 2 bp, Homo sapiens
cg

SEQ ID NO: 13003 - DNA, 2 bp, Homo sapiens
cg

SEQ ID NO: 13004 - DNA, 2 bp, Homo sapiens
cg

SEQ ID NO: 13005 - DNA, 2 bp, Homo sapiens
cg

SEQ ID NO: 13006 - DNA, 2 bp, Homo sapiens
cg

SEQ ID NO: 13007 - DNA, 2 bp, Homo sapiens
cg

SEQ ID NO: 13008 - DNA, 2 bp, Homo sapiens
cg

SEQ ID NO: 13009 - DNA, 2 bp, Homo sapiens
cg

SEQ ID NO: 13010 - DNA, 2 bp, Homo sapiens
cg

SEQ ID NO: 13011 - DNA, 2 bp, Homo sapiens
cg

SEQ ID NO: 13012 - DNA, 2 bp, Homo sapiens
cg

SEQ ID NO: 13013 - DNA, 2 bp, Homo sapiens
cg

SEQ ID NO: 13014 - DNA, 2 bp, Homo sapiens
cg

SEQ ID NO: 13015 - DNA, 2 bp, Homo sapiens
cg

SEQ ID NO: 13016 - DNA, 2 bp, Homo sapiens
cg

SEQ ID NO: 13017 - DNA, 2 bp, Homo sapiens
cg

SEQ ID NO: 13018 - DNA, 2 bp, Homo sapiens
cg

SEQ ID NO: 13019 - DNA, 18 bp, Homo sapiens
cgcggtcaggaaggcgcg

SEQ ID NO: 13020 - DNA, 18 bp, Homo sapiens
cgcactcactgacctgcg

SEQ ID NO: 13021 - DNA, 2 bp, Homo sapiens
cg

SEQ ID NO: 13022 - DNA, 2 bp, Homo sapiens
cg

SEQ ID NO: 13023 - DNA, 2 bp, Homo sapiens
cg

SEQ ID NO: 13024 - DNA, 2 bp, Homo sapiens
cg

SEQ ID NO: 13025 - DNA, 2 bp, Homo sapiens
cg

SEQ ID NO: 13026 - DNA, 2 bp, Homo sapiens
cg

SEQ ID NO: 13027 - DNA, 2 bp, Homo sapiens
cg

SEQ ID NO: 13028 - DNA, 2 bp, Homo sapiens
cg

SEQ ID NO: 13029 - DNA, 2 bp, Homo sapiens
cg

SEQ ID NO: 13030 - DNA, 2 bp, Homo sapiens
cg

SEQ ID NO: 13031 - DNA, 87 bp, Homo sapiens
cgtcacccatttatttgactcggaaagggaactctctgaccccttgcgcttcccaggtgaggcaatgcctcgccctgcttcggctcg

SEQ ID NO: 13032 - DNA, 2 bp, Homo sapiens
cg

SEQ ID NO: 13033 - DNA, 2 bp, Homo sapiens
cg

SEQ ID NO: 13034 - DNA, 2 bp, Homo sapiens
cg

SEQ ID NO: 13035 - DNA, 2 bp, Homo sapiens
cg

SEQ ID NO: 13036 - DNA, 2 bp, Homo sapiens
cg

SEQ ID NO: 13037 - DNA, 2 bp, Homo sapiens
cg

SEQ ID NO: 13038 - DNA, 2 bp, Homo sapiens
cg

SEQ ID NO: 13039 - DNA, 2 bp, Homo sapiens
cg

SEQ ID NO: 13040 - DNA, 2 bp, Homo sapiens
cg

SEQ ID NO: 13041 - DNA, 2 bp, Homo sapiens
cg

SEQ ID NO: 13042 - DNA, 11 bp, Homo sapiens
cgcaagctccg

SEQ ID NO: 13043 - DNA, 2 bp, Homo sapiens
cg

SEQ ID NO: 13044 - DNA, 2 bp, Homo sapiens
cg

SEQ ID NO: 13045 - DNA, 2 bp, Homo sapiens
cg

SEQ ID NO: 13046 - DNA, 2 bp, Homo sapiens
cg

SEQ ID NO: 13047 - DNA, 2 bp, Homo sapiens
cg

SEQ ID NO: 13048 - DNA, 2 bp, Homo sapiens
cg

SEQ ID NO: 13049 - DNA, 2 bp, Homo sapiens
cg

SEQ ID NO: 13050 - DNA, 2 bp, Homo sapiens
cg

SEQ ID NO: 13051 - DNA, 2 bp, Homo sapiens
cg

SEQ ID NO: 13052 - DNA, 2 bp, Homo sapiens
cg

SEQ ID NO: 13053 - DNA, 2 bp, Homo sapiens
cg

SEQ ID NO: 13054 - DNA, 2 bp, Homo sapiens
cg

SEQ ID NO: 13055 - DNA, 2 bp, Homo sapiens
cg

SEQ ID NO: 13056 - DNA, 2 bp, Homo sapiens
cg

SEQ ID NO: 13057 - DNA, 2 bp, Homo sapiens
cg

SEQ ID NO: 13058 - DNA, 2 bp, Homo sapiens
cg

SEQ ID NO: 13059 - DNA, 2 bp, Homo sapiens
cg

SEQ ID NO: 13060 - DNA, 2 bp, Homo sapiens
cg

SEQ ID NO: 13061 - DNA, 2 bp, Homo sapiens
cg

SEQ ID NO: 13062 - DNA, 167 bp, Homo sapiens
cgccattttttaagccggtctgaaaagcgcaatattcgggtgggagtgacccgattttctaggtgcgtcggtcacccctttccttgactcggaaagggaactccctgacccctggcgcttcccaggtgaggcaatgcctcgccctgcttcggctcgcccacggtgcg

SEQ ID NO: 13063 - DNA, 2 bp, Homo sapiens
cg

SEQ ID NO: 13064 - DNA, 2 bp, Homo sapiens
cg

SEQ ID NO: 13065 - DNA, 2 bp, Homo sapiens
cg

SEQ ID NO: 13066 - DNA, 185 bp, Homo sapiens
cggtgcttacatacgctgcttttaaaaaaatttgctttgttcaggtttgtgtgaatacaacgccggatgaactctgtcccttcagaagaaagccgggttggtgtgctcgatgacgcagcgcttgcagtggcgtttgacaaagcgcagggcctccacggagacctcgcagtcctggacattcagcg

SEQ ID NO: 13067 - DNA, 17 bp, Homo sapiens
cgccctgcttcggctcg

SEQ ID NO: 13068 - DNA, 135 bp, Homo sapiens
cgcaatattcgggtgggagtgacccgattttccaggtgcgtccgtcacccctttctttgactaggaaagggaactccctgacccctggcgcttcccgagtgaggcattgccttaccctgcttcggctcgcgcacg

SEQ ID NO: 13069 - DNA, 2 bp, Homo sapiens
cg

SEQ ID NO: 13070 - DNA, 71 bp, Homo sapiens
cggcgggctgaagggctcctcaagcgcggccagagtgggtgccaaggccgaggaggcgccaagagcgagcg

SEQ ID NO: 13071 - DNA, 54 bp, Homo sapiens
cgcttcccaagtgaggcaatgcctcgccctgcttcggctcgcgcacggtgcgcg

SEQ ID NO: 13072 - DNA, 5 bp, Homo sapiens
cgccg

SEQ ID NO: 13073 - DNA, 29 bp, Homo sapiens
cgcttttcctacgggcttaaaaaccggcg

SEQ ID NO: 13074 - DNA, 18 bp, Homo sapiens
cgcagacactagaaagcg

SEQ ID NO: 13075 - DNA, 2 bp, Homo sapiens
cg

SEQ ID NO: 13076 - DNA, 5 bp, Homo sapiens
cgtcg

SEQ ID NO: 13077 - DNA, 24 bp, Homo sapiens
cgagtctgcgcaggaggcgcttcg

SEQ ID NO: 13078 - DNA, 2 bp, Homo sapiens
cg

SEQ ID NO: 13079 - DNA, 4 bp, Homo sapiens
cgcg

SEQ ID NO: 13080 - DNA, 2 bp, Homo sapiens
cg

SEQ ID NO: 13081 - DNA, 2 bp, Homo sapiens
cg

SEQ ID NO: 13082 - DNA, 2 bp, Homo sapiens
cg

SEQ ID NO: 13083 - DNA, 2 bp, Homo sapiens
cg

SEQ ID NO: 13084 - DNA, 2 bp, Homo sapiens
cg

SEQ ID NO: 13085 - DNA, 2 bp, Homo sapiens
cg

SEQ ID NO: 13086 - DNA, 2 bp, Homo sapiens
cg

SEQ ID NO: 13087 - DNA, 2 bp, Homo sapiens
cg

SEQ ID NO: 13088 - DNA, 2 bp, Homo sapiens
cg

SEQ ID NO: 13089 - DNA, 2 bp, Homo sapiens
cg

SEQ ID NO: 13090 - DNA, 12 bp, Homo sapiens
cgacctgccccg

SEQ ID NO: 13091 - DNA, 2 bp, Homo sapiens
cg

SEQ ID NO: 13092 - DNA, 2 bp, Homo sapiens
cg

SEQ ID NO: 13093 - DNA, 2 bp, Homo sapiens
cg

SEQ ID NO: 13094 - DNA, 2 bp, Homo sapiens
cg

SEQ ID NO: 13095 - DNA, 2 bp, Homo sapiens
cg

SEQ ID NO: 13096 - DNA, 2 bp, Homo sapiens
cg

SEQ ID NO: 13097 - DNA, 2 bp, Homo sapiens
cg

SEQ ID NO: 13098 - DNA, 2 bp, Homo sapiens
cg

SEQ ID NO: 13099 - DNA, 2 bp, Homo sapiens
cg

SEQ ID NO: 13100 - DNA, 2 bp, Homo sapiens
cg

SEQ ID NO: 13101 - DNA, 2 bp, Homo sapiens
cg

SEQ ID NO: 13102 - DNA, 2 bp, Homo sapiens
cg

SEQ ID NO: 13103 - DNA, 2 bp, Homo sapiens
cg

SEQ ID NO: 13104 - DNA, 2 bp, Homo sapiens
cg

SEQ ID NO: 13105 - DNA, 2 bp, Homo sapiens
cg

SEQ ID NO: 13106 - DNA, 2 bp, Homo sapiens
cg

SEQ ID NO: 13107 - DNA, 2 bp, Homo sapiens
cg

SEQ ID NO: 13108 - DNA, 2 bp, Homo sapiens
cg

SEQ ID NO: 13109 - DNA, 2 bp, Homo sapiens
cg

SEQ ID NO: 13110 - DNA, 2 bp, Homo sapiens
cg

SEQ ID NO: 13111 - DNA, 2 bp, Homo sapiens
cg

SEQ ID NO: 13112 - DNA, 80 bp, Homo sapiens
cgcagcggaaggcctggagcagaggctgcttctccgcccaagcactccctgggtgagtccatactcctggcgcgagtacg

SEQ ID NO: 13113 - DNA, 2 bp, Homo sapiens
cg

SEQ ID NO: 13114 - DNA, 2 bp, Homo sapiens
cg

SEQ ID NO: 13115 - DNA, 2 bp, Homo sapiens
cg

SEQ ID NO: 13116 - DNA, 2 bp, Homo sapiens
cg

SEQ ID NO: 13117 - DNA, 2 bp, Homo sapiens
cg

SEQ ID NO: 13118 - DNA, 2 bp, Homo sapiens
cg

SEQ ID NO: 13119 - DNA, 2 bp, Homo sapiens
cg

SEQ ID NO: 13120 - DNA, 2 bp, Homo sapiens
cg

SEQ ID NO: 13121 - DNA, 2 bp, Homo sapiens
cg

SEQ ID NO: 13122 - DNA, 2 bp, Homo sapiens
cg

SEQ ID NO: 13123 - DNA, 4 bp, Homo sapiens
cgcg

SEQ ID NO: 13124 - DNA, 2 bp, Homo sapiens
cg

SEQ ID NO: 13125 - DNA, 2 bp, Homo sapiens
cg

SEQ ID NO: 13126 - DNA, 2 bp, Homo sapiens
cg

SEQ ID NO: 13127 - DNA, 2 bp, Homo sapiens
cg

SEQ ID NO: 13128 - DNA, 2 bp, Homo sapiens
cg

SEQ ID NO: 13129 - DNA, 2 bp, Homo sapiens
cg

SEQ ID NO: 13130 - DNA, 2 bp, Homo sapiens
cg

SEQ ID NO: 13131 - DNA, 2 bp, Homo sapiens
cg

SEQ ID NO: 13132 - DNA, 2 bp, Homo sapiens
cg

SEQ ID NO: 13133 - DNA, 2 bp, Homo sapiens
cg

SEQ ID NO: 13134 - DNA, 3039 bp, Homo sapiens
cgcacgattctgggtgcaagccagagactccacaaacacgccgggccctgcgcagcggcttccgggaaggcactgtcatccgtgggagggcccggcccgccactttttaccccctgctgcctcaacgtcaccttccaagcctggcgtcctcttcccttcccctggaggccttcgtgctgctttggggtgccccctgtgggcgagacacacaacctgggtgcaagccagggactccgcgaccatccctggcccggcgcaggggtggccatccttgggacgacaccatcccgccacttttttccttggactgtctccactatccccttcaaccctggcgtcctgtacccttcccccagtggccttcttgccgctttgtggtgctccccgtgggtgagacacgcacccggggtgcaagacagggactccaggacgctcccgggcccactgcagaggctgctgggaaggcagtgtcgtccgtgagaggaccccagcatccccgctttttttccccggggctgcctcaacttcccccttcaagactgacgtgctgtccctttcccccgggaaccttcttgctgctttgtggtgcccgccgtgggcaagacactcaccctgggtgcaagccagggaatcaacaacccccgcatgcccggcaaaggggctgccggtaaggcactgtcattcgtgggatcaccccagcctcgctgcttttttctccaggctacctaaacgtccccattcaagcctggcgtcctgttgccttcccgcgggggacttcttgccactttggggtgccccccgtgggcgagacacgcacattgtgtgcaagacagggactccgcgaccctcccgggactggcataggggctgtagggaaggcactgtcatccgtgaaaggaccccagcctcgcccctttttttcctgggctgcctcaacgtcccctttcaagtctggcatcctgttcttccccccccggggctttcttgctgctttggggtgccacccgtgggcgaggcacgcaccctgggtgtaaaccagggactccaagacccccagggccaggcgcaggggatgtcgggaagtcactgtcctccgtggaaagtttttccctggactgcctcaaagtcccctttcaagcctggcatcctgttcccttcccccggagcccttcttgcagctttcgcgtgcacacttaggcgagacacgcactctgttgcaagacagggactccaaacccccccgcctgggccaggctcaggggctgccgggaaggcactgtggtctgtgggacgaccacagcctagccgctgttttcctctggctggcccaacgtccctcttcaagcctgacatgttgtccccttcccccgggggccctgttgccactttcacgtgcaccccgtgagcaagacaggcaccctgggtccaagccaggggctccaccgtccacctgggtcccactcagaggctgccgggaaggcactgttctcagtggaaattttttccccggactgcctcaacgtcccctttcaagctcggcgtcctgttcccttccactcggggacttcttaccgcattgcggtgcccatcgtgggcacgacacgcaccccgggtgcaagccagggactccacaaccaccccaggcccgatgcaggggctaccggacaagacactgttgtccttgggatgacaccggtctgcctcaactctacctttcaaccctggagtcctgtacccttcccctgggggccttcttgctgctttgtggtgccactcgtgggcgagacacacaacctgggagcaagccagagactccacgacacctctgggcccactgcagaggctgccaggaaggcggtgtcatccgtgggaggaccccagcttcaccacttttaccccggggccgcctcaacctccccttcaagcctgacgtgctctcccttcccccgggaatctacttgccgctttggggtgcccccttgagcgagacacgcaccctgggtgcaagccacggactccaggaccaccctggcccagcgaaggggctgccaggaaggcactgtcgtttgtgggagaaactcagcgtcgccgtttttttccacgggctacctcaaagtcccccttcaagtctgaggtgctgtccccttcccccaggggcctacttgccgctttggggtgcctcccatgggcgaaacacgcaccctgggtgcaagatagggactccacgatccccccgggcccagcgcagggactgccaggaaggcactgtcatccgtaggaggaacccgactagccgcttttctctctgtgctgcctcagcatccccattaaagcctggccttctgtggcgttcgcccggcggccttcttgccactttggggtgcccccatgggtgcgacccgcaccctcggtgcaagccagggactccacgaccaccccgggcctgacgcaggggctgctgggaaggcactgtcgtccatgggacgaccccagcctgccacgtttttccccggactgcctcaactatccctttcaaccctggcgtcccatacccttcccccggtggccttcttgccgctttgtggtgccccccgagggcgagacacgcaccttgggtgcaagccaaggactccatgacgctcccaggcccaccacagatgctgtcgggaagacagtgttatccgtggcaggaccccagcatcccctctttattcccggggctgcctcaacgtccccctccaagcctgacgtgctgtccccttcccctgggaacctacttgccgctttggggtgccccccgtggaaccctgggtgcaagcctgggacacaacaaccccctcgggcctggcaaaggggctgccgggaaggcaccgtggtccgtgggaagttttttcctggactgcttcaaagtcccctttcaagcctggcgtcctgttcccttcccagggggcattcttgccgctttggggtgtccccccgtgggcgcgacacgcaccctgggttcaagtcaggaactccacgacaaccccgagtctggcg

SEQ ID NO: 13135 - DNA, 2 bp, Homo sapiens
cg

SEQ ID NO: 13136 - DNA, 2 bp, Homo sapiens
cg

SEQ ID NO: 13137 - DNA, 2 bp, Homo sapiens
cg

SEQ ID NO: 13138 - DNA, 2 bp, Homo sapiens
cg

SEQ ID NO: 13139 - DNA, 2 bp, Homo sapiens
cg

SEQ ID NO: 13140 - DNA, 2 bp, Homo sapiens
cg

SEQ ID NO: 13141 - DNA, 2 bp, Homo sapiens
cg

SEQ ID NO: 13142 - DNA, 2 bp, Homo sapiens
cg

SEQ ID NO: 13143 - DNA, 2 bp, Homo sapiens
cg

SEQ ID NO: 13144 - DNA, 2 bp, Homo sapiens
cg

SEQ ID NO: 13145 - DNA, 2 bp, Artificial Sequence
  Description of Artificial Sequence: Synthetic oligonucleotide
yg

SEQ ID NO: 13146 - DNA, 9 bp, Artificial Sequence
  Description of Artificial Sequence: Synthetic oligonucleotide
ygaatggyg

SEQ ID NO: 13147 - DNA, 2 bp, Artificial Sequence
  Description of Artificial Sequence: Synthetic oligonucleotide
yg

SEQ ID NO: 13148 - DNA, 2 bp, Artificial Sequence
  Description of Artificial Sequence: Synthetic oligonucleotide
yg

SEQ ID NO: 13149 - DNA, 2 bp, Artificial Sequence
  Description of Artificial Sequence: Synthetic oligonucleotide
yg

SEQ ID NO: 13150 - DNA, 2 bp, Artificial Sequence
  Description of Artificial Sequence: Synthetic oligonucleotide
yg

SEQ ID NO: 13151 - DNA, 2 bp, Artificial Sequence
  Description of Artificial Sequence: Synthetic oligonucleotide
yg

SEQ ID NO: 13152 - DNA, 2 bp, Artificial Sequence
  Description of Artificial Sequence: Synthetic oligonucleotide
yg

SEQ ID NO: 13153 - DNA, 2 bp, Artificial Sequence
  Description of Artificial Sequence: Synthetic oligonucleotide
yg

SEQ ID NO: 13154 - DNA, 2 bp, Artificial Sequence
  Description of Artificial Sequence: Synthetic oligonucleotide
yg

SEQ ID NO: 13155 - DNA, 2 bp, Artificial Sequence
  Description of Artificial Sequence: Synthetic oligonucleotide
yg

SEQ ID NO: 13156 - DNA, 2 bp, Artificial Sequence
  Description of Artificial Sequence: Synthetic oligonucleotide
yg

SEQ ID NO: 13157 - DNA, 36 bp, Artificial Sequence
  Description of Artificial Sequence: Synthetic oligonucleotide
yggtttaygtagggtgygygtatttattgatttgyg

SEQ ID NO: 13158 - DNA, 2 bp, Artificial Sequence
  Description of Artificial Sequence: Synthetic oligonucleotide
yg

SEQ ID NO: 13159 - DNA, 2 bp, Artificial Sequence
  Description of Artificial Sequence: Synthetic oligonucleotide
yg

SEQ ID NO: 13160 - DNA, 2 bp, Artificial Sequence
  Description of Artificial Sequence: Synthetic oligonucleotide
yg

SEQ ID NO: 13161 - DNA, 2 bp, Artificial Sequence
  Description of Artificial Sequence: Synthetic oligonucleotide
yg

SEQ ID NO: 13162 - DNA, 2 bp, Artificial Sequence
  Description of Artificial Sequence: Synthetic oligonucleotide
yg

SEQ ID NO: 13163 - DNA, 2 bp, Artificial Sequence
  Description of Artificial Sequence: Synthetic oligonucleotide
yg

SEQ ID NO: 13164 - DNA, 2 bp, Artificial Sequence
  Description of Artificial Sequence: Synthetic oligonucleotide
yg

SEQ ID NO: 13165 - DNA, 2 bp, Artificial Sequence
  Description of Artificial Sequence: Synthetic oligonucleotide
yg

SEQ ID NO: 13166 - DNA, 2 bp, Artificial Sequence
  Description of Artificial Sequence: Synthetic oligonucleotide
yg

SEQ ID NO: 13167 - DNA, 2 bp, Artificial Sequence
  Description of Artificial Sequence: Synthetic oligonucleotide
yg

SEQ ID NO: 13168 - DNA, 8 bp, Artificial Sequence
  Description of Artificial Sequence: Synthetic oligonucleotide
ygayggyg

SEQ ID NO: 13169 - DNA, 2 bp, Artificial Sequence
  Description of Artificial Sequence: Synthetic oligonucleotide
yg

SEQ ID NO: 13170 - DNA, 2 bp, Artificial Sequence
  Description of Artificial Sequence: Synthetic oligonucleotide
yg

SEQ ID NO: 13171 - DNA, 2 bp, Artificial Sequence
  Description of Artificial Sequence: Synthetic oligonucleotide
yg

SEQ ID NO: 13172 - DNA, 2 bp, Artificial Sequence
  Description of Artificial Sequence: Synthetic oligonucleotide
yg

SEQ ID NO: 13173 - DNA, 2 bp, Artificial Sequence
  Description of Artificial Sequence: Synthetic oligonucleotide
yg

SEQ ID NO: 13174 - DNA, 2 bp, Artificial Sequence
  Description of Artificial Sequence: Synthetic oligonucleotide
yg

SEQ ID NO: 13175 - DNA, 2 bp, Artificial Sequence
  Description of Artificial Sequence: Synthetic oligonucleotide
yg

SEQ ID NO: 13176 - DNA, 2 bp, Artificial Sequence
  Description of Artificial Sequence: Synthetic oligonucleotide
yg

SEQ ID NO: 13177 - DNA, 2 bp, Artificial Sequence
  Description of Artificial Sequence: Synthetic oligonucleotide
yg

SEQ ID NO: 13178 - DNA, 2 bp, Artificial Sequence
  Description of Artificial Sequence: Synthetic oligonucleotide
yg

SEQ ID NO: 13179 - DNA, 181 bp, Artificial Sequence
  Description of Artificial Sequence: Synthetic polynucleotide
yggagattgtagtgagtygagatygtgttattgtattttaatggtattttagtttgatgatagagygagatttygttttaaaaataataataaataaataaataaataaataaaaattagttgggygtggtggygtgtgtttgtagttttagttattygggagattgaggtaggagaatyg

SEQ ID NO: 13180 - DNA, 2 bp, Artificial Sequence
  Description of Artificial Sequence: Synthetic oligonucleotide
yg

SEQ ID NO: 13181 - DNA, 2 bp, Artificial Sequence
  Description of Artificial Sequence: Synthetic oligonucleotide
yg

SEQ ID NO: 13182 - DNA, 2 bp, Artificial Sequence
  Description of Artificial Sequence: Synthetic oligonucleotide
yg

SEQ ID NO: 13183 - DNA, 2 bp, Artificial Sequence
  Description of Artificial Sequence: Synthetic oligonucleotide
yg

SEQ ID NO: 13184 - DNA, 2 bp, Artificial Sequence
  Description of Artificial Sequence: Synthetic oligonucleotide
yg

SEQ ID NO: 13185 - DNA, 2 bp, Artificial Sequence
  Description of Artificial Sequence: Synthetic oligonucleotide
yg

SEQ ID NO: 13186 - DNA, 2 bp, Artificial Sequence
  Description of Artificial Sequence: Synthetic oligonucleotide
yg

SEQ ID NO: 13187 - DNA, 2 bp, Artificial Sequence
  Description of Artificial Sequence: Synthetic oligonucleotide
yg

SEQ ID NO: 13188 - DNA, 2 bp, Artificial Sequence
  Description of Artificial Sequence: Synthetic oligonucleotide
yg

SEQ ID NO: 13189 - DNA, 2 bp, Artificial Sequence
  Description of Artificial Sequence: Synthetic oligonucleotide
yg

SEQ ID NO: 13190 - DNA, 369 bp, Artificial Sequence
  Description of Artificial Sequence: Synthetic polynucleotide
ygygtttgaggagttttttagttygtygttgtattgtgggagtttttttttgggttggataaggttggagtyggtttttttagtttgygggtaggtgtggagagagaggygtgggygggaatygtggttgtaggttgygtttgygggttagttygagtttygggtgggygtgggtttggtaagtttygtattyggagyggttagtyggttygggtagtgaggagtttagtatttgggttagtagttgttgtgttygatttttygttgggttttagttgttttttygtygggtagggttygggatttgtagttttttatgtttgagtttttattttygtygtgygtttttgtgtagtttaagttttttyg

SEQ ID NO: 13191 - DNA, 2 bp, Artificial Sequence
  Description of Artificial Sequence: Synthetic oligonucleotide
yg

SEQ ID NO: 13192 - DNA, 2 bp, Artificial Sequence
  Description of Artificial Sequence: Synthetic oligonucleotide
yg

SEQ ID NO: 13193 - DNA, 2 bp, Artificial Sequence
  Description of Artificial Sequence: Synthetic oligonucleotide
yg

SEQ ID NO: 13194 - DNA, 2 bp, Artificial Sequence
  Description of Artificial Sequence: Synthetic oligonucleotide
yg

SEQ ID NO: 13195 - DNA, 2 bp, Artificial Sequence
  Description of Artificial Sequence: Synthetic oligonucleotide
yg

SEQ ID NO: 13196 - DNA, 2 bp, Artificial Sequence
  Description of Artificial Sequence: Synthetic oligonucleotide
yg

SEQ ID NO: 13197 - DNA, 2 bp, Artificial Sequence
  Description of Artificial Sequence: Synthetic oligonucleotide
yg

SEQ ID NO: 13198 - DNA, 2 bp, Artificial Sequence
  Description of Artificial Sequence: Synthetic oligonucleotide
yg

SEQ ID NO: 13199 - DNA, 2 bp, Artificial Sequence
  Description of Artificial Sequence: Synthetic oligonucleotide
yg

SEQ ID NO: 13200 - DNA, 2 bp, Artificial Sequence
  Description of Artificial Sequence: Synthetic oligonucleotide
yg

SEQ ID NO: 13201 - DNA, 2 bp, Artificial Sequence
  Description of Artificial Sequence: Synthetic oligonucleotide
yg

SEQ ID NO: 13202 - DNA, 2 bp, Artificial Sequence
  Description of Artificial Sequence: Synthetic oligonucleotide
yg

SEQ ID NO: 13203 - DNA, 2 bp, Artificial Sequence
  Description of Artificial Sequence: Synthetic oligonucleotide
yg

SEQ ID NO: 13204 - DNA, 2 bp, Artificial Sequence
  Description of Artificial Sequence: Synthetic oligonucleotide
yg

SEQ ID NO: 13205 - DNA, 2 bp, Artificial Sequence
  Description of Artificial Sequence: Synthetic oligonucleotide
yg

SEQ ID NO: 13206 - DNA, 2 bp, Artificial Sequence
  Description of Artificial Sequence: Synthetic oligonucleotide
yg

SEQ ID NO: 13207 - DNA, 2 bp, Artificial Sequence
  Description of Artificial Sequence: Synthetic oligonucleotide
yg

SEQ ID NO: 13208 - DNA, 2 bp, Artificial Sequence
  Description of Artificial Sequence: Synthetic oligonucleotide
yg

SEQ ID NO: 13209 - DNA, 2 bp, Artificial Sequence
  Description of Artificial Sequence: Synthetic oligonucleotide
yg

SEQ ID NO: 13210 - DNA, 2 bp, Artificial Sequence
  Description of Artificial Sequence: Synthetic oligonucleotide
yg

SEQ ID NO: 13211 - DNA, 2 bp, Artificial Sequence
  Description of Artificial Sequence: Synthetic oligonucleotide
yg

SEQ ID NO: 13212 - DNA, 35 bp, Artificial Sequence
  Description of Artificial Sequence: Synthetic oligonucleotide
ygtttgtattattatttygattttatttattatyg

SEQ ID NO: 13213 - DNA, 2 bp, Artificial Sequence
  Description of Artificial Sequence: Synthetic oligonucleotide
yg

SEQ ID NO: 13214 - DNA, 2 bp, Artificial Sequence
  Description of Artificial Sequence: Synthetic oligonucleotide
yg

SEQ ID NO: 13215 - DNA, 2 bp, Artificial Sequence
  Description of Artificial Sequence: Synthetic oligonucleotide
yg

SEQ ID NO: 13216 - DNA, 2 bp, Artificial Sequence
  Description of Artificial Sequence: Synthetic oligonucleotide
yg

SEQ ID NO: 13217 - DNA, 2 bp, Artificial Sequence
  Description of Artificial Sequence: Synthetic oligonucleotide
yg

SEQ ID NO: 13218 - DNA, 2 bp, Artificial Sequence
  Description of Artificial Sequence: Synthetic oligonucleotide
yg

SEQ ID NO: 13219 - DNA, 2 bp, Artificial Sequence
  Description of Artificial Sequence: Synthetic oligonucleotide
yg

SEQ ID NO: 13220 - DNA, 2 bp, Artificial Sequence
  Description of Artificial Sequence: Synthetic oligonucleotide
yg

SEQ ID NO: 13221 - DNA, 2 bp, Artificial Sequence
  Description of Artificial Sequence: Synthetic oligonucleotide
yg

SEQ ID NO: 13222 - DNA, 2 bp, Artificial Sequence
  Description of Artificial Sequence: Synthetic oligonucleotide
yg

SEQ ID NO: 13223 - DNA, 487 bp, Artificial Sequence
  Description of Artificial Sequence: Synthetic polynucleotide
ygtttagggygggaatttagygtaygggtgaggattttaaaaagtaaggggtaggatgagttaataaggttttgagtaggaaaattatgygataggaagtgtatatattgttttatagtagaaagatyggggaygggattagtttttaagygattttaaatttaaaaggaagtaatttttagatttttatgggygttttaatttgttttgggtgaaggaagataggtaagaatttttaggtttgtgaggattttaygttttagggatagaagtgttagggatttgggaagtgtagatttaatataaggtagagtaaaatttaygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyg

SEQ ID NO: 13224 - DNA, 2 bp, Artificial Sequence
  Description of Artificial Sequence: Synthetic oligonucleotide
yg

SEQ ID NO: 13225 - DNA, 2 bp, Artificial Sequence
  Description of Artificial Sequence: Synthetic oligonucleotide
yg

SEQ ID NO: 13226 - DNA, 2 bp, Artificial Sequence
  Description of Artificial Sequence: Synthetic oligonucleotide
yg

SEQ ID NO: 13227 - DNA, 2 bp, Artificial Sequence
  Description of Artificial Sequence: Synthetic oligonucleotide
yg

SEQ ID NO: 13228 - DNA, 2 bp, Artificial Sequence
  Description of Artificial Sequence: Synthetic oligonucleotide
yg

SEQ ID NO: 13229 - DNA, 2 bp, Artificial Sequence
  Description of Artificial Sequence: Synthetic oligonucleotide
yg

SEQ ID NO: 13230 - DNA, 2 bp, Artificial Sequence
  Description of Artificial Sequence: Synthetic oligonucleotide
yg

SEQ ID NO: 13231 - DNA, 2 bp, Artificial Sequence
  Description of Artificial Sequence: Synthetic oligonucleotide
yg

SEQ ID NO: 13232 - DNA, 2 bp, Artificial Sequence
  Description of Artificial Sequence: Synthetic oligonucleotide
yg

SEQ ID NO: 13233 - DNA, 2 bp, Artificial Sequence
  Description of Artificial Sequence: Synthetic oligonucleotide
yg

SEQ ID NO: 13234 - DNA, 28 bp, Artificial Sequence
  Description of Artificial Sequence: Synthetic oligonucleotide
ygttttgattttttgatttygtgattyg

SEQ ID NO: 13235 - DNA, 2 bp, Artificial Sequence
  Description of Artificial Sequence: Synthetic oligonucleotide
yg

SEQ ID NO: 13236 - DNA, 2 bp, Artificial Sequence
  Description of Artificial Sequence: Synthetic oligonucleotide
yg

SEQ ID NO: 13237 - DNA, 2 bp, Artificial Sequence
  Description of Artificial Sequence: Synthetic oligonucleotide
yg

SEQ ID NO: 13238 - DNA, 2 bp, Artificial Sequence
  Description of Artificial Sequence: Synthetic oligonucleotide
yg

SEQ ID NO: 13239 - DNA, 2 bp, Artificial Sequence
  Description of Artificial Sequence: Synthetic oligonucleotide
yg

SEQ ID NO: 13240 - DNA, 2 bp, Artificial Sequence
  Description of Artificial Sequence: Synthetic oligonucleotide
yg

SEQ ID NO: 13241 - DNA, 2 bp, Artificial Sequence
  Description of Artificial Sequence: Synthetic oligonucleotide
yg

SEQ ID NO: 13242 - DNA, 2 bp, Artificial Sequence
  Description of Artificial Sequence: Synthetic oligonucleotide
yg

SEQ ID NO: 13243 - DNA, 2 bp, Artificial Sequence
  Description of Artificial Sequence: Synthetic oligonucleotide
yg

SEQ ID NO: 13244 - DNA, 2 bp, Artificial Sequence
  Description of Artificial Sequence: Synthetic oligonucleotide
yg

SEQ ID NO: 13245 - DNA, 2 bp, Artificial Sequence
  Description of Artificial Sequence: Synthetic oligonucleotide
yg

SEQ ID NO: 13246 - DNA, 2 bp, Artificial Sequence
  Description of Artificial Sequence: Synthetic oligonucleotide
yg

SEQ ID NO: 13247 - DNA, 2 bp, Artificial Sequence
  Description of Artificial Sequence: Synthetic oligonucleotide
yg

SEQ ID NO: 13248 - DNA, 2 bp, Artificial Sequence
  Description of Artificial Sequence: Synthetic oligonucleotide
yg

SEQ ID NO: 13249 - DNA, 2 bp, Artificial Sequence
  Description of Artificial Sequence: Synthetic oligonucleotide
yg

SEQ ID NO: 13250 - DNA, 2 bp, Artificial Sequence
  Description of Artificial Sequence: Synthetic oligonucleotide
yg

SEQ ID NO: 13251 - DNA, 2 bp, Artificial Sequence
  Description of Artificial Sequence: Synthetic oligonucleotide
yg

SEQ ID NO: 13252 - DNA, 2 bp, Artificial Sequence
  Description of Artificial Sequence: Synthetic oligonucleotide
yg

SEQ ID NO: 13253 - DNA, 2 bp, Artificial Sequence
  Description of Artificial Sequence: Synthetic oligonucleotide
yg

SEQ ID NO: 13254 - DNA, 2 bp, Artificial Sequence
  Description of Artificial Sequence: Synthetic oligonucleotide
yg

SEQ ID NO: 13255 - DNA, 2 bp, Artificial Sequence
  Description of Artificial Sequence: Synthetic oligonucleotide
yg

SEQ ID NO: 13256 - DNA, 18 bp, Artificial Sequence
  Description of Artificial Sequence: Synthetic oligonucleotide
ygygtttttttgatygyg

SEQ ID NO: 13257 - DNA, 18 bp, Artificial Sequence
  Description of Artificial Sequence: Synthetic oligonucleotide
ygtaggttagtgagtgyg

SEQ ID NO: 13258 - DNA, 2 bp, Artificial Sequence
  Description of Artificial Sequence: Synthetic oligonucleotide
yg

SEQ ID NO: 13259 - DNA, 2 bp, Artificial Sequence
  Description of Artificial Sequence: Synthetic oligonucleotide
yg

SEQ ID NO: 13260 - DNA, 2 bp, Artificial Sequence
  Description of Artificial Sequence: Synthetic oligonucleotide
yg

SEQ ID NO: 13261 - DNA, 2 bp, Artificial Sequence
  Description of Artificial Sequence: Synthetic oligonucleotide
yg

SEQ ID NO: 13262 - DNA, 2 bp, Artificial Sequence
  Description of Artificial Sequence: Synthetic oligonucleotide
yg

SEQ ID NO: 13263 - DNA, 2 bp, Artificial Sequence
  Description of Artificial Sequence: Synthetic oligonucleotide
yg

SEQ ID NO: 13264 - DNA, 2 bp, Artificial Sequence
  Description of Artificial Sequence: Synthetic oligonucleotide
yg

SEQ ID NO: 13265 - DNA, 2 bp, Artificial Sequence
  Description of Artificial Sequence: Synthetic oligonucleotide
yg

SEQ ID NO: 13266 - DNA, 2 bp, Artificial Sequence
  Description of Artificial Sequence: Synthetic oligonucleotide
yg

SEQ ID NO: 13267 - DNA, 2 bp, Artificial Sequence
  Description of Artificial Sequence: Synthetic oligonucleotide
yg

SEQ ID NO: 13268 - DNA, 87 bp, Artificial Sequence
  Description of Artificial Sequence: Synthetic oligonucleotide
ygagtygaagtagggygaggtattgttttatttgggaagygtaaggggttagagagtttttttttygagttaaataaatgggtgayg

SEQ ID NO: 13269 - DNA, 2 bp, Artificial Sequence
  Description of Artificial Sequence: Synthetic oligonucleotide
yg

SEQ ID NO: 13270 - DNA, 2 bp, Artificial Sequence
  Description of Artificial Sequence: Synthetic oligonucleotide
yg

SEQ ID NO: 13271 - DNA, 2 bp, Artificial Sequence
  Description of Artificial Sequence: Synthetic oligonucleotide
yg

SEQ ID NO: 13272 - DNA, 2 bp, Artificial Sequence
  Description of Artificial Sequence: Synthetic oligonucleotide
yg

SEQ ID NO: 13273 - DNA, 2 bp, Artificial Sequence
  Description of Artificial Sequence: Synthetic oligonucleotide
yg

SEQ ID NO: 13274 - DNA, 2 bp, Artificial Sequence
  Description of Artificial Sequence: Synthetic oligonucleotide
yg

SEQ ID NO: 13275 - DNA, 2 bp, Artificial Sequence
  Description of Artificial Sequence: Synthetic oligonucleotide
yg

SEQ ID NO: 13276 - DNA, 2 bp, Artificial Sequence
  Description of Artificial Sequence: Synthetic oligonucleotide
yg

SEQ ID NO: 13277 - DNA, 2 bp, Artificial Sequence
  Description of Artificial Sequence: Synthetic oligonucleotide
yg

SEQ ID NO: 13278 - DNA, 2 bp, Artificial Sequence
  Description of Artificial Sequence: Synthetic oligonucleotide
yg

SEQ ID NO: 13279 - DNA, 11 bp, Artificial Sequence
  Description of Artificial Sequence: Synthetic oligonucleotide
yggagtttgyg

SEQ ID NO: 13280 - DNA, 2 bp, Artificial Sequence
  Description of Artificial Sequence: Synthetic oligonucleotide
yg

SEQ ID NO: 13281 - DNA, 2 bp, Artificial Sequence
  Description of Artificial Sequence: Synthetic oligonucleotide
yg

SEQ ID NO: 13282 - DNA, 2 bp, Artificial Sequence
  Description of Artificial Sequence: Synthetic oligonucleotide
yg

SEQ ID NO: 13283 - DNA, 2 bp, Artificial Sequence
  Description of Artificial Sequence: Synthetic oligonucleotide
yg

SEQ ID NO: 13284 - DNA, 2 bp, Artificial Sequence
  Description of Artificial Sequence: Synthetic oligonucleotide
yg

SEQ ID NO: 13285 - DNA, 2 bp, Artificial Sequence
  Description of Artificial Sequence: Synthetic oligonucleotide
yg

SEQ ID NO: 13286 - DNA, 2 bp, Artificial Sequence
  Description of Artificial Sequence: Synthetic oligonucleotide
yg

SEQ ID NO: 13287 - DNA, 2 bp, Artificial Sequence
  Description of Artificial Sequence: Synthetic oligonucleotide
yg

SEQ ID NO: 13288 - DNA, 2 bp, Artificial Sequence
  Description of Artificial Sequence: Synthetic oligonucleotide
yg

SEQ ID NO: 13289 - DNA, 2 bp, Artificial Sequence
  Description of Artificial Sequence: Synthetic oligonucleotide
yg

SEQ ID NO: 13290 - DNA, 2 bp, Artificial Sequence
  Description of Artificial Sequence: Synthetic oligonucleotide
yg

SEQ ID NO: 13291 - DNA, 2 bp, Artificial Sequence
  Description of Artificial Sequence: Synthetic oligonucleotide
yg

SEQ ID NO: 13292 - DNA, 2 bp, Artificial Sequence
  Description of Artificial Sequence: Synthetic oligonucleotide
yg

SEQ ID NO: 13293 - DNA, 2 bp, Artificial Sequence
  Description of Artificial Sequence: Synthetic oligonucleotide
yg

SEQ ID NO: 13294 - DNA, 2 bp, Artificial Sequence
  Description of Artificial Sequence: Synthetic oligonucleotide
yg

SEQ ID NO: 13295 - DNA, 2 bp, Artificial Sequence
  Description of Artificial Sequence: Synthetic oligonucleotide
yg

SEQ ID NO: 13296 - DNA, 2 bp, Artificial Sequence
  Description of Artificial Sequence: Synthetic oligonucleotide
yg

SEQ ID NO: 13297 - DNA, 2 bp, Artificial Sequence
  Description of Artificial Sequence: Synthetic oligonucleotide
yg

SEQ ID NO: 13298 - DNA, 2 bp, Artificial Sequence
  Description of Artificial Sequence: Synthetic oligonucleotide
yg

SEQ ID NO: 13299 - DNA, 167 bp, Artificial Sequence
  Description of Artificial Sequence: Synthetic polynucleotide
ygtatygtgggygagtygaagtagggygaggtattgttttatttgggaagygttaggggttagggagtttttttttygagttaaggaaaggggtgatygaygtatttagaaaatygggttatttttattygaatattgygttttttagatyggtttaaaaaatggyg

SEQ ID NO: 13300 - DNA, 2 bp, Artificial Sequence
  Description of Artificial Sequence: Synthetic oligonucleotide
yg

SEQ ID NO: 13301 - DNA, 2 bp, Artificial Sequence
  Description of Artificial Sequence: Synthetic oligonucleotide
yg

SEQ ID NO: 13302 - DNA, 2 bp, Artificial Sequence
  Description of Artificial Sequence: Synthetic oligonucleotide
yg

SEQ ID NO: 13303 - DNA, 185 bp, Artificial Sequence
  Description of Artificial Sequence: Synthetic polynucleotide
ygttgaatgtttaggattgygaggttttygtggaggttttgygttttgttaaaygttattgtaagygttgygttatygagtatattaattyggtttttttttgaagggatagagtttattyggygttgtatttatataaatttgaataaagtaaatttttttaaaagtagygtatgtaagtatyg

SEQ ID NO: 13304 - DNA, 17 bp, Artificial Sequence
  Description of Artificial Sequence: Synthetic oligonucleotide
ygagtygaagtagggyg

SEQ ID NO: 13305 - DNA, 135 bp, Artificial Sequence
  Description of Artificial Sequence: Synthetic polynucleotide
ygtgygygagtygaagtagggtaaggtaatgttttattygggaagygttaggggttagggagtttttttttttagttaaagaaaggggtgayggaygtatttggaaaatygggttatttttattygaatattgyg

SEQ ID NO: 13306 - DNA, 2 bp, Artificial Sequence
  Description of Artificial Sequence: Synthetic oligonucleotide
yg

SEQ ID NO: 13307 - DNA, 71 bp, Artificial Sequence
  Description of Artificial Sequence: Synthetic oligonucleotide
ygttygtttttggygttttttyggttttggtatttattttggtygygtttgaggagttttttagttygtyg

SEQ ID NO: 13308 - DNA, 54 bp, Artificial Sequence
  Description of Artificial Sequence: Synthetic oligonucleotide
ygygtatygtgygygagtygaagtagggygaggtattgttttatttgggaagyg

SEQ ID NO: 13309 - DNA, 5 bp, Artificial Sequence
  Description of Artificial Sequence: Synthetic oligonucleotide
yggyg

SEQ ID NO: 13310 - DNA, 29 bp, Artificial Sequence
  Description of Artificial Sequence: Synthetic oligonucleotide
ygtyggtttttaagttygtaggaaaagyg

SEQ ID NO: 13311 - DNA, 18 bp, Artificial Sequence
  Description of Artificial Sequence: Synthetic oligonucleotide
ygttttttagtgtttgyg

SEQ ID NO: 13312 - DNA, 2 bp, Artificial Sequence
  Description of Artificial Sequence: Synthetic oligonucleotide
yg

SEQ ID NO: 13313 - DNA, 5 bp, Artificial Sequence
  Description of Artificial Sequence: Synthetic oligonucleotide
ygayg

SEQ ID NO: 13314 - DNA, 24 bp, Artificial Sequence
  Description of Artificial Sequence: Synthetic oligonucleotide
ygaagygttttttgygtagattyg

SEQ ID NO: 13315 - DNA, 2 bp, Artificial Sequence
  Description of Artificial Sequence: Synthetic oligonucleotide
yg

SEQ ID NO: 13316 - DNA, 4 bp, Artificial Sequence
  Description of Artificial Sequence: Synthetic oligonucleotide
ygyg

SEQ ID NO: 13317 - DNA, 2 bp, Artificial Sequence
  Description of Artificial Sequence: Synthetic oligonucleotide
yg

SEQ ID NO: 13318 - DNA, 2 bp, Artificial Sequence
  Description of Artificial Sequence: Synthetic oligonucleotide
yg

SEQ ID NO: 13319 - DNA, 2 bp, Artificial Sequence
  Description of Artificial Sequence: Synthetic oligonucleotide
yg

SEQ ID NO: 13320 - DNA, 2 bp, Artificial Sequence
  Description of Artificial Sequence: Synthetic oligonucleotide
yg

SEQ ID NO: 13321 - DNA, 2 bp, Artificial Sequence
  Description of Artificial Sequence: Synthetic oligonucleotide
yg

SEQ ID NO: 13322 - DNA, 2 bp, Artificial Sequence
  Description of Artificial Sequence: Synthetic oligonucleotide
yg

SEQ ID NO: 13323 - DNA, 2 bp, Artificial Sequence
  Description of Artificial Sequence: Synthetic oligonucleotide
yg

SEQ ID NO: 13324 - DNA, 2 bp, Artificial Sequence
  Description of Artificial Sequence: Synthetic oligonucleotide
yg

SEQ ID NO: 13325 - DNA, 2 bp, Artificial Sequence
  Description of Artificial Sequence: Synthetic oligonucleotide
yg

SEQ ID NO: 13326 - DNA, 2 bp, Artificial Sequence
  Description of Artificial Sequence: Synthetic oligonucleotide
yg

SEQ ID NO: 13327 - DNA, 12 bp, Artificial Sequence
  Description of Artificial Sequence: Synthetic oligonucleotide
yggggtaggtyg

SEQ ID NO: 13328 - DNA, 2 bp, Artificial Sequence
  Description of Artificial Sequence: Synthetic oligonucleotide
yg

SEQ ID NO: 13329 - DNA, 2 bp, Artificial Sequence
  Description of Artificial Sequence: Synthetic oligonucleotide
yg

SEQ ID NO: 13330 - DNA, 2 bp, Artificial Sequence
  Description of Artificial Sequence: Synthetic oligonucleotide
yg

SEQ ID NO: 13331 - DNA, 2 bp, Artificial Sequence
  Description of Artificial Sequence: Synthetic oligonucleotide
yg

SEQ ID NO: 13332 - DNA, 2 bp, Artificial Sequence
  Description of Artificial Sequence: Synthetic oligonucleotide
yg

SEQ ID NO: 13333 - DNA, 2 bp, Artificial Sequence
  Description of Artificial Sequence: Synthetic oligonucleotide
yg

SEQ ID NO: 13334 - DNA, 2 bp, Artificial Sequence
  Description of Artificial Sequence: Synthetic oligonucleotide
yg

SEQ ID NO: 13335 - DNA, 2 bp, Artificial Sequence
  Description of Artificial Sequence: Synthetic oligonucleotide
yg

SEQ ID NO: 13336 - DNA, 2 bp, Artificial Sequence
  Description of Artificial Sequence: Synthetic oligonucleotide
yg

SEQ ID NO: 13337 - DNA, 2 bp, Artificial Sequence
  Description of Artificial Sequence: Synthetic oligonucleotide
yg

SEQ ID NO: 13338 - DNA, 2 bp, Artificial Sequence
  Description of Artificial Sequence: Synthetic oligonucleotide
yg

SEQ ID NO: 13339 - DNA, 2 bp, Artificial Sequence
  Description of Artificial Sequence: Synthetic oligonucleotide
yg

SEQ ID NO: 13340 - DNA, 2 bp, Artificial Sequence
  Description of Artificial Sequence: Synthetic oligonucleotide
yg

SEQ ID NO: 13341 - DNA, 2 bp, Artificial Sequence
  Description of Artificial Sequence: Synthetic oligonucleotide
yg

SEQ ID NO: 13342 - DNA, 2 bp, Artificial Sequence
  Description of Artificial Sequence: Synthetic oligonucleotide
yg

SEQ ID NO: 13343 - DNA, 2 bp, Artificial Sequence
  Description of Artificial Sequence: Synthetic oligonucleotide
yg

SEQ ID NO: 13344 - DNA, 2 bp, Artificial Sequence
  Description of Artificial Sequence: Synthetic oligonucleotide
yg

SEQ ID NO: 13345 - DNA, 2 bp, Artificial Sequence
  Description of Artificial Sequence: Synthetic oligonucleotide
yg

SEQ ID NO: 13346 - DNA, 2 bp, Artificial Sequence
  Description of Artificial Sequence: Synthetic oligonucleotide
yg

SEQ ID NO: 13347 - DNA, 2 bp, Artificial Sequence
  Description of Artificial Sequence: Synthetic oligonucleotide
yg

SEQ ID NO: 13348 - DNA, 2 bp, Artificial Sequence
  Description of Artificial Sequence: Synthetic oligonucleotide
yg

SEQ ID NO: 13349 - DNA, 80 bp, Artificial Sequence
  Description of Artificial Sequence: Synthetic oligonucleotide
ygtattygygttaggagtatggatttatttagggagtgtttgggyggagaagtagtttttgttttaggtttttygttgyg

SEQ ID NO: 13350 - DNA, 2 bp, Artificial Sequence
  Description of Artificial Sequence: Synthetic oligonucleotide
yg

SEQ ID NO: 13351 - DNA, 2 bp, Artificial Sequence
  Description of Artificial Sequence: Synthetic oligonucleotide
yg

SEQ ID NO: 13352 - DNA, 2 bp, Artificial Sequence
  Description of Artificial Sequence: Synthetic oligonucleotide
yg

SEQ ID NO: 13353 - DNA, 2 bp, Artificial Sequence
  Description of Artificial Sequence: Synthetic oligonucleotide
yg

SEQ ID NO: 13354 - DNA, 2 bp, Artificial Sequence
  Description of Artificial Sequence: Synthetic oligonucleotide
yg

SEQ ID NO: 13355 - DNA, 2 bp, Artificial Sequence
  Description of Artificial Sequence: Synthetic oligonucleotide
yg

SEQ ID NO: 13356 - DNA, 2 bp, Artificial Sequence
  Description of Artificial Sequence: Synthetic oligonucleotide
yg

SEQ ID NO: 13357 - DNA, 2 bp, Artificial Sequence
  Description of Artificial Sequence: Synthetic oligonucleotide
yg

SEQ ID NO: 13358 - DNA, 2 bp, Artificial Sequence
  Description of Artificial Sequence: Synthetic oligonucleotide
yg

SEQ ID NO: 13359 - DNA, 2 bp, Artificial Sequence
  Description of Artificial Sequence: Synthetic oligonucleotide
yg

SEQ ID NO: 13360 - DNA, 4 bp, Artificial Sequence
  Description of Artificial Sequence: Synthetic oligonucleotide
ygyg

SEQ ID NO: 13361 - DNA, 2 bp, Artificial Sequence
  Description of Artificial Sequence: Synthetic oligonucleotide
yg

SEQ ID NO: 13362 - DNA, 2 bp, Artificial Sequence
  Description of Artificial Sequence: Synthetic oligonucleotide
yg

SEQ ID NO: 13363 - DNA, 2 bp, Artificial Sequence
  Description of Artificial Sequence: Synthetic oligonucleotide
yg

SEQ ID NO: 13364 - DNA, 2 bp, Artificial Sequence
  Description of Artificial Sequence: Synthetic oligonucleotide
yg

SEQ ID NO: 13365 - DNA, 2 bp, Artificial Sequence
  Description of Artificial Sequence: Synthetic oligonucleotide
yg

SEQ ID NO: 13366 - DNA, 2 bp, Artificial Sequence
  Description of Artificial Sequence: Synthetic oligonucleotide
yg

SEQ ID NO: 13367 - DNA, 2 bp, Artificial Sequence
  Description of Artificial Sequence: Synthetic oligonucleotide
yg

SEQ ID NO: 13368 - DNA, 2 bp, Artificial Sequence
  Description of Artificial Sequence: Synthetic oligonucleotide
yg

SEQ ID NO: 13369 - DNA, 2 bp, Artificial Sequence
  Description of Artificial Sequence: Synthetic oligonucleotide
yg

SEQ ID NO: 13370 - DNA, 2 bp, Artificial Sequence
  Description of Artificial Sequence: Synthetic oligonucleotide
yg

SEQ ID NO: 13371 - DNA, 3039 bp, Artificial Sequence
  Description of Artificial Sequence: Synthetic polynucleotide
ygttagattyggggttgtygtggagtttttgatttgaatttagggtgygtgtygygtttayggggggatattttaaagyggtaagaatgttttttgggaagggaataggaygttaggtttgaaaggggattttgaagtagtttaggaaaaaattttttayggattayggtgttttttyggtagtttttttgttaggttygagggggttgttgtgttttaggtttgtatttagggttttayggggggtattttaaagyggtaagtaggtttttaggggaaggggatagtaygttaggtttggagggggaygttgaggtagtttygggaataaagaggggatgttggggttttgttayggataatattgttttttygatagtatttgtggtgggtttgggagygttatggagtttttggtttgtatttaaggtgygtgtttygttttyggggggtattataaagyggtaagaaggttatygggggaagggtatgggaygttagggttgaaagggatagttgaggtagttyggggaaaaaygtggtaggttggggtygttttatggaygatagtgtttttttagtagtttttgygttaggttyggggtggtygtggagtttttggtttgtatygagggtgygggtygtatttatgggggtattttaaagtggtaagaaggtygtygggygaaygttatagaaggttaggttttaatggggatgttgaggtagtatagagagaaaagyggttagtygggttttttttayggatgatagtgtttttttggtagtttttgygttgggttyggggggatygtggagtttttattttgtatttagggtgygtgtttygtttatgggaggtattttaaagyggtaagtaggtttttgggggaaggggatagtattttagatttgaagggggattttgaggtagttygtggaaaaaaayggygaygttgagttttttttataaaygatagtgtttttttggtagttttttygttgggttagggtggttttggagttygtggtttgtatttagggtgygtgtttygtttaagggggtattttaaagyggtaagtagattttygggggaagggagagtaygttaggtttgaaggggaggttgaggyggtttyggggtaaaagtggtgaagttggggtttttttayggatgatatygtttttttggtagtttttgtagtgggtttagaggtgtygtggagtttttggtttgtttttaggttgtgtgtttygtttaygagtggtattataaagtagtaagaaggtttttaggggaagggtataggattttagggttgaaaggtagagttgaggtagatyggtgttattttaaggataatagtgttttgttyggtagtttttgtatygggtttggggtggttgtggagtttttggtttgtattyggggtgygtgtygtgtttaygatgggtatygtaatgyggtaagaagttttygagtggaagggaataggaygtygagtttgaaaggggaygttgaggtagttyggggaaaaaatttttattgagaatagtgttttttyggtagtttttgagtgggatttaggtggayggtggagtttttggtttggatttagggtgtttgttttgtttayggggtgtaygtgaaagtggtaatagggttttygggggaaggggataatatgttaggtttgaagagggaygttgggttagttagaggaaaatagyggttaggttgtggtygttttatagattatagtgttttttyggtagtttttgagtttggtttaggygggggggtttggagtttttgttttgtaatagagtgygtgtttygtttaagtgtgtaygygaaagttgtaagaagggtttygggggaagggaataggatgttaggtttgaaaggggattttgaggtagtttagggaaaaattttttayggaggatagtgatttttygatattttttgygtttggttttgggggttttggagtttttggtttatatttagggtgygtgtttygtttaygggtggtattttaaagtagtaagaaagtttyggggggggaagaataggatgttagatttgaaaggggaygttgaggtagtttaggaaaaaaaggggygaggttggggtttttttayggatgatagtgttttttttatagtttttatgttagtttygggagggtygyggagtttttgttttgtatataatgtgygtgtttygtttayggggggtattttaaagtggtaagaagtttttygygggaaggtaataggaygttaggtttgaatggggaygtttaggtagtttggagaaaaaagtagygaggttggggtgattttaygaatgatagtgttttatyggtagtttttttgtygggtatgygggggttgttgattttttggtttgtatttagggtgagtgttttgtttayggygggtattataaagtagtaagaaggttttygggggaaagggatagtaygttagttttgaagggggaagttgaggtagtttyggggaaaaaaagyggggatgttggggtttttttayggaygatattgtttttttagtagtttttgtagtgggttygggagygttttggagtttttgttttgtatttygggtgygtgttttatttayggggagtattataaagyggtaagaaggttattgggggaagggtataggaygttagggttgaaggggatagtggagatagtttaaggaaaaaagtggygggatggtgtygttttaaggatggttatttttgygtygggttagggatggtygyggagtttttggtttgtatttaggttgtgtgtttygtttatagggggtattttaaagtagtaygaaggtttttaggggaagggaagaggaygttaggtttggaaggtgaygttgaggtagtagggggtaaaaagtggygggtygggtttttttayggatgatagtgttttttyggaagtygttgygtagggttyggygtgtttgtggagtttttggtttgtatttagaatygtgyg

SEQ ID NO: 13372 - DNA, 2 bp, Artificial Sequence
  Description of Artificial Sequence: Synthetic oligonucleotide
yg

SEQ ID NO: 13373 - DNA, 2 bp, Artificial Sequence
  Description of Artificial Sequence: Synthetic oligonucleotide
yg

SEQ ID NO: 13374 - DNA, 2 bp, Artificial Sequence
  Description of Artificial Sequence: Synthetic oligonucleotide
yg

SEQ ID NO: 13375 - DNA, 2 bp, Artificial Sequence
  Description of Artificial Sequence: Synthetic oligonucleotide
yg

SEQ ID NO: 13376 - DNA, 2 bp, Artificial Sequence
  Description of Artificial Sequence: Synthetic oligonucleotide
yg

SEQ ID NO: 13377 - DNA, 2 bp, Artificial Sequence
  Description of Artificial Sequence: Synthetic oligonucleotide
yg

SEQ ID NO: 13378 - DNA, 2 bp, Artificial Sequence
  Description of Artificial Sequence: Synthetic oligonucleotide
yg

SEQ ID NO: 13379 - DNA, 2 bp, Artificial Sequence
  Description of Artificial Sequence: Synthetic oligonucleotide
yg

SEQ ID NO: 13380 - DNA, 2 bp, Artificial Sequence
  Description of Artificial Sequence: Synthetic oligonucleotide
yg

SEQ ID NO: 13381 - DNA, 2 bp, Artificial Sequence
  Description of Artificial Sequence: Synthetic oligonucleotide
yg

SEQ ID NO: 13382 - DNA, 2 bp, Artificial Sequence
  Description of Artificial Sequence: Synthetic oligonucleotide
tg

SEQ ID NO: 13383 - DNA, 9 bp, Artificial Sequence
  Description of Artificial Sequence: Synthetic oligonucleotide
tgaatggtg

SEQ ID NO: 13384 - DNA, 2 bp, Artificial Sequence
  Description of Artificial Sequence: Synthetic oligonucleotide
tg

SEQ ID NO: 13385 - DNA, 2 bp, Artificial Sequence
  Description of Artificial Sequence: Synthetic oligonucleotide
tg

SEQ ID NO: 13386 - DNA, 2 bp, Artificial Sequence
  Description of Artificial Sequence: Synthetic oligonucleotide
tg

SEQ ID NO: 13387 - DNA, 2 bp, Artificial Sequence
  Description of Artificial Sequence: Synthetic oligonucleotide
tg

SEQ ID NO: 13388 - DNA, 2 bp, Artificial Sequence
  Description of Artificial Sequence: Synthetic oligonucleotide
tg

SEQ ID NO: 13389 - DNA, 2 bp, Artificial Sequence
  Description of Artificial Sequence: Synthetic oligonucleotide
tg

SEQ ID NO: 13390 - DNA, 2 bp, Artificial Sequence
  Description of Artificial Sequence: Synthetic oligonucleotide
tg

SEQ ID NO: 13391 - DNA, 2 bp, Artificial Sequence
  Description of Artificial Sequence: Synthetic oligonucleotide
tg

SEQ ID NO: 13392 - DNA, 2 bp, Artificial Sequence
  Description of Artificial Sequence: Synthetic oligonucleotide
tg

SEQ ID NO: 13393 - DNA, 2 bp, Artificial Sequence
  Description of Artificial Sequence: Synthetic oligonucleotide
tg

SEQ ID NO: 13394 - DNA, 36 bp, Artificial Sequence
  Description of Artificial Sequence: Synthetic oligonucleotide
tggtttatgtagggtgtgtgtatttattgatttgtg

SEQ ID NO: 13395 - DNA, 2 bp, Artificial Sequence
  Description of Artificial Sequence: Synthetic oligonucleotide
tg

SEQ ID NO: 13396 - DNA, 2 bp, Artificial Sequence
  Description of Artificial Sequence: Synthetic oligonucleotide
tg

SEQ ID NO: 13397 - DNA, 2 bp, Artificial Sequence
  Description of Artificial Sequence: Synthetic oligonucleotide
tg

SEQ ID NO: 13398 - DNA, 2 bp, Artificial Sequence
  Description of Artificial Sequence: Synthetic oligonucleotide
tg

SEQ ID NO: 13399 - DNA, 2 bp, Artificial Sequence
  Description of Artificial Sequence: Synthetic oligonucleotide
tg

SEQ ID NO: 13400 - DNA, 2 bp, Artificial Sequence
  Description of Artificial Sequence: Synthetic oligonucleotide
tg

SEQ ID NO: 13401 - DNA, 2 bp, Artificial Sequence
  Description of Artificial Sequence: Synthetic oligonucleotide
tg

SEQ ID NO: 13402 - DNA, 2 bp, Artificial Sequence
  Description of Artificial Sequence: Synthetic oligonucleotide
tg

SEQ ID NO: 13403 - DNA, 2 bp, Artificial Sequence
  Description of Artificial Sequence: Synthetic oligonucleotide
tg

SEQ ID NO: 13404 - DNA, 2 bp, Artificial Sequence
  Description of Artificial Sequence: Synthetic oligonucleotide
tg

SEQ ID NO: 13405 - DNA, 8 bp, Artificial Sequence
  Description of Artificial Sequence: Synthetic oligonucleotide
tgatggtg

SEQ ID NO: 13406 - DNA, 2 bp, Artificial Sequence
  Description of Artificial Sequence: Synthetic oligonucleotide
tg

SEQ ID NO: 13407 - DNA, 2 bp, Artificial Sequence
  Description of Artificial Sequence: Synthetic oligonucleotide
tg

SEQ ID NO: 13408 - DNA, 2 bp, Artificial Sequence
  Description of Artificial Sequence: Synthetic oligonucleotide
tg

SEQ ID NO: 13409 - DNA, 2 bp, Artificial Sequence
  Description of Artificial Sequence: Synthetic oligonucleotide
tg

SEQ ID NO: 13410 - DNA, 2 bp, Artificial Sequence
  Description of Artificial Sequence: Synthetic oligonucleotide
tg

SEQ ID NO: 13411 - DNA, 2 bp, Artificial Sequence
  Description of Artificial Sequence: Synthetic oligonucleotide
tg

SEQ ID NO: 13412 - DNA, 2 bp, Artificial Sequence
  Description of Artificial Sequence: Synthetic oligonucleotide
tg

SEQ ID NO: 13413 - DNA, 2 bp, Artificial Sequence
  Description of Artificial Sequence: Synthetic oligonucleotide
tg

SEQ ID NO: 13414 - DNA, 2 bp, Artificial Sequence
  Description of Artificial Sequence: Synthetic oligonucleotide
tg

SEQ ID NO: 13415 - DNA, 2 bp, Artificial Sequence
  Description of Artificial Sequence: Synthetic oligonucleotide
tg

SEQ ID NO: 13416 - DNA, 181 bp, Artificial Sequence
  Description of Artificial Sequence: Synthetic polynucleotide
tggagattgtagtgagttgagattgtgttattgtattttaatggtattttagtttgatgatagagtgagattttgttttaaaaataataataaataaataaataaataaataaaaattagttgggtgtggtggtgtgtgtttgtagttttagttatttgggagattgaggtaggagaattg

SEQ ID NO: 13417 - DNA, 2 bp, Artificial Sequence
  Description of Artificial Sequence: Synthetic oligonucleotide
tg

SEQ ID NO: 13418 - DNA, 2 bp, Artificial Sequence
  Description of Artificial Sequence: Synthetic oligonucleotide
tg

SEQ ID NO: 13419 - DNA, 2 bp, Artificial Sequence
  Description of Artificial Sequence: Synthetic oligonucleotide
tg

SEQ ID NO: 13420 - DNA, 2 bp, Artificial Sequence
  Description of Artificial Sequence: Synthetic oligonucleotide
tg

SEQ ID NO: 13421 - DNA, 2 bp, Artificial Sequence
  Description of Artificial Sequence: Synthetic oligonucleotide
tg

SEQ ID NO: 13422 - DNA, 2 bp, Artificial Sequence
  Description of Artificial Sequence: Synthetic oligonucleotide
tg

SEQ ID NO: 13423 - DNA, 2 bp, Artificial Sequence
  Description of Artificial Sequence: Synthetic oligonucleotide
tg

SEQ ID NO: 13424 - DNA, 2 bp, Artificial Sequence
  Description of Artificial Sequence: Synthetic oligonucleotide
tg

SEQ ID NO: 13425 - DNA, 2 bp, Artificial Sequence
  Description of Artificial Sequence: Synthetic oligonucleotide
tg

SEQ ID NO: 13426 - DNA, 2 bp, Artificial Sequence
  Description of Artificial Sequence: Synthetic oligonucleotide
tg

SEQ ID NO: 13427 - DNA, 369 bp, Artificial Sequence
  Description of Artificial Sequence: Synthetic polynucleotide
tgtgtttgaggagttttttagtttgttgttgtattgtgggagtttttttttgggttggataaggttggagttggtttttttagtttgtgggtaggtgtggagagagaggtgtgggtgggaattgtggttgtaggttgtgtttgtgggttagtttgagttttgggtgggtgtgggtttggtaagttttgtatttggagtggttagttggtttgggtagtgaggagtttagtatttgggttagtagttgttgtgtttgattttttgttgggttttagttgtttttttgttgggtagggtttgggatttgtagttttttatgtttgagtttttatttttgttgtgtgtttttgtgtagtttaagtttttttg

SEQ ID NO: 13428 - DNA, 2 bp, Artificial Sequence
  Description of Artificial Sequence: Synthetic oligonucleotide
tg

SEQ ID NO: 13429 - DNA, 2 bp, Artificial Sequence
  Description of Artificial Sequence: Synthetic oligonucleotide
tg

SEQ ID NO: 13430 - DNA, 2 bp, Artificial Sequence
  Description of Artificial Sequence: Synthetic oligonucleotide
tg

SEQ ID NO: 13431 - DNA, 2 bp, Artificial Sequence
  Description of Artificial Sequence: Synthetic oligonucleotide
tg

SEQ ID NO: 13432 - DNA, 2 bp, Artificial Sequence
  Description of Artificial Sequence: Synthetic oligonucleotide
tg

SEQ ID NO: 13433 - DNA, 2 bp, Artificial Sequence
  Description of Artificial Sequence: Synthetic oligonucleotide
tg

SEQ ID NO: 13434 - DNA, 2 bp, Artificial Sequence
  Description of Artificial Sequence: Synthetic oligonucleotide
tg

SEQ ID NO: 13435 - DNA, 2 bp, Artificial Sequence
  Description of Artificial Sequence: Synthetic oligonucleotide
tg

SEQ ID NO: 13436 - DNA, 2 bp, Artificial Sequence
  Description of Artificial Sequence: Synthetic oligonucleotide
tg

SEQ ID NO: 13437 - DNA, 2 bp, Artificial Sequence
  Description of Artificial Sequence: Synthetic oligonucleotide
tg

SEQ ID NO: 13438 - DNA, 2 bp, Artificial Sequence
  Description of Artificial Sequence: Synthetic oligonucleotide
tg

SEQ ID NO: 13439 - DNA, 2 bp, Artificial Sequence
  Description of Artificial Sequence: Synthetic oligonucleotide
tg

SEQ ID NO: 13440 - DNA, 2 bp, Artificial Sequence
  Description of Artificial Sequence: Synthetic oligonucleotide
tg

SEQ ID NO: 13441 - DNA, 2 bp, Artificial Sequence
  Description of Artificial Sequence: Synthetic oligonucleotide
tg

SEQ ID NO: 13442 - DNA, 2 bp, Artificial Sequence
  Description of Artificial Sequence: Synthetic oligonucleotide
tg

SEQ ID NO: 13443 - DNA, 2 bp, Artificial Sequence
  Description of Artificial Sequence: Synthetic oligonucleotide
tg

SEQ ID NO: 13444 - DNA, 2 bp, Artificial Sequence
  Description of Artificial Sequence: Synthetic oligonucleotide
tg

SEQ ID NO: 13445 - DNA, 2 bp, Artificial Sequence
  Description of Artificial Sequence: Synthetic oligonucleotide
tg

SEQ ID NO: 13446 - DNA, 2 bp, Artificial Sequence
  Description of Artificial Sequence: Synthetic oligonucleotide
tg

SEQ ID NO: 13447 - DNA, 2 bp, Artificial Sequence
  Description of Artificial Sequence: Synthetic oligonucleotide
tg

SEQ ID NO: 13448 - DNA, 2 bp, Artificial Sequence
  Description of Artificial Sequence: Synthetic oligonucleotide
tg

SEQ ID NO: 13449 - DNA, 35 bp, Artificial Sequence
  Description of Artificial Sequence: Synthetic oligonucleotide
tgtttgtattattattttgattttatttattattg

SEQ ID NO: 13450 - DNA, 2 bp, Artificial Sequence
  Description of Artificial Sequence: Synthetic oligonucleotide
tg

SEQ ID NO: 13451 - DNA, 2 bp, Artificial Sequence
  Description of Artificial Sequence: Synthetic oligonucleotide
tg

SEQ ID NO: 13452 - DNA, 2 bp, Artificial Sequence
  Description of Artificial Sequence: Synthetic oligonucleotide
tg

SEQ ID NO: 13453 - DNA, 2 bp, Artificial Sequence
  Description of Artificial Sequence: Synthetic oligonucleotide
tg

SEQ ID NO: 13454 - DNA, 2 bp, Artificial Sequence
  Description of Artificial Sequence: Synthetic oligonucleotide
tg

SEQ ID NO: 13455 - DNA, 2 bp, Artificial Sequence
  Description of Artificial Sequence: Synthetic oligonucleotide
tg

SEQ ID NO: 13456 - DNA, 2 bp, Artificial Sequence
  Description of Artificial Sequence: Synthetic oligonucleotide
tg

SEQ ID NO: 13457 - DNA, 2 bp, Artificial Sequence
  Description of Artificial Sequence: Synthetic oligonucleotide
tg

SEQ ID NO: 13458 - DNA, 2 bp, Artificial Sequence
  Description of Artificial Sequence: Synthetic oligonucleotide
tg

SEQ ID NO: 13459 - DNA, 2 bp, Artificial Sequence
  Description of Artificial Sequence: Synthetic oligonucleotide
tg

SEQ ID NO: 13460 - DNA, 487 bp, Artificial Sequence
  Description of Artificial Sequence: Synthetic polynucleotide
tgtttagggtgggaatttagtgtatgggtgaggattttaaaaagtaaggggtaggatgagttaataaggttttgagtaggaaaattatgtgataggaagtgtatatattgttttatagtagaaagattggggatgggattagtttttaagtgattttaaatttaaaaggaagtaatttttagatttttatgggtgttttaatttgttttgggtgaaggaagataggtaagaatttttaggtttgtgaggattttatgttttagggatagaagtgttagggatttgggaagtgtagatttaatataaggtagagtaaaatttatgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtg

SEQ ID NO: 13461 - DNA, 2 bp, Artificial Sequence
  Description of Artificial Sequence: Synthetic oligonucleotide
tg

SEQ ID NO: 13462 - DNA, 2 bp, Artificial Sequence
  Description of Artificial Sequence: Synthetic oligonucleotide
tg

SEQ ID NO: 13463 - DNA, 2 bp, Artificial Sequence
  Description of Artificial Sequence: Synthetic oligonucleotide
tg

SEQ ID NO: 13464 - DNA, 2 bp, Artificial Sequence
  Description of Artificial Sequence: Synthetic oligonucleotide
tg

SEQ ID NO: 13465 - DNA, 2 bp, Artificial Sequence
  Description of Artificial Sequence: Synthetic oligonucleotide
tg

SEQ ID NO: 13466 - DNA, 2 bp, Artificial Sequence
  Description of Artificial Sequence: Synthetic oligonucleotide
tg

SEQ ID NO: 13467 - DNA, 2 bp, Artificial Sequence
  Description of Artificial Sequence: Synthetic oligonucleotide
tg

SEQ ID NO: 13468 - DNA, 2 bp, Artificial Sequence
  Description of Artificial Sequence: Synthetic oligonucleotide
tg

SEQ ID NO: 13469 - DNA, 2 bp, Artificial Sequence
  Description of Artificial Sequence: Synthetic oligonucleotide
tg

SEQ ID NO: 13470 - DNA, 2 bp, Artificial Sequence
  Description of Artificial Sequence: Synthetic oligonucleotide
tg

SEQ ID NO: 13471 - DNA, 28 bp, Artificial Sequence
  Description of Artificial Sequence: Synthetic oligonucleotide
tgttttgattttttgattttgtgatttg

SEQ ID NO: 13472 - DNA, 2 bp, Artificial Sequence
  Description of Artificial Sequence: Synthetic oligonucleotide
tg

SEQ ID NO: 13473 - DNA, 2 bp, Artificial Sequence
  Description of Artificial Sequence: Synthetic oligonucleotide
tg

SEQ ID NO: 13474 - DNA, 2 bp, Artificial Sequence
  Description of Artificial Sequence: Synthetic oligonucleotide
tg

SEQ ID NO: 13475 - DNA, 2 bp, Artificial Sequence
  Description of Artificial Sequence: Synthetic oligonucleotide
tg

SEQ ID NO: 13476 - DNA, 2 bp, Artificial Sequence
  Description of Artificial Sequence: Synthetic oligonucleotide
tg

SEQ ID NO: 13477 - DNA, 2 bp, Artificial Sequence
  Description of Artificial Sequence: Synthetic oligonucleotide
tg

SEQ ID NO: 13478 - DNA, 2 bp, Artificial Sequence
  Description of Artificial Sequence: Synthetic oligonucleotide
tg

SEQ ID NO: 13479 - DNA, 2 bp, Artificial Sequence
  Description of Artificial Sequence: Synthetic oligonucleotide
tg

SEQ ID NO: 13480 - DNA, 2 bp, Artificial Sequence
  Description of Artificial Sequence: Synthetic oligonucleotide
tg

SEQ ID NO: 13481 - DNA, 2 bp, Artificial Sequence
  Description of Artificial Sequence: Synthetic oligonucleotide
tg

SEQ ID NO: 13482 - DNA, 2 bp, Artificial Sequence
  Description of Artificial Sequence: Synthetic oligonucleotide
tg

SEQ ID NO: 13483 - DNA, 2 bp, Artificial Sequence
  Description of Artificial Sequence: Synthetic oligonucleotide
tg

SEQ ID NO: 13484 - DNA, 2 bp, Artificial Sequence
  Description of Artificial Sequence: Synthetic oligonucleotide
tg

SEQ ID NO: 13485 - DNA, 2 bp, Artificial Sequence
  Description of Artificial Sequence: Synthetic oligonucleotide
tg

SEQ ID NO: 13486 - DNA, 2 bp, Artificial Sequence
  Description of Artificial Sequence: Synthetic oligonucleotide
tg

SEQ ID NO: 13487 - DNA, 2 bp, Artificial Sequence
  Description of Artificial Sequence: Synthetic oligonucleotide
tg

SEQ ID NO: 13488 - DNA, 2 bp, Artificial Sequence
  Description of Artificial Sequence: Synthetic oligonucleotide
tg

SEQ ID NO: 13489 - DNA, 2 bp, Artificial Sequence
  Description of Artificial Sequence: Synthetic oligonucleotide
tg

SEQ ID NO: 13490 - DNA, 2 bp, Artificial Sequence
  Description of Artificial Sequence: Synthetic oligonucleotide
tg

SEQ ID NO: 13491 - DNA, 2 bp, Artificial Sequence
  Description of Artificial Sequence: Synthetic oligonucleotide
tg

SEQ ID NO: 13492 - DNA, 2 bp, Artificial Sequence
  Description of Artificial Sequence: Synthetic oligonucleotide
tg

SEQ ID NO: 13493 - DNA, 18 bp, Artificial Sequence
  Description of Artificial Sequence: Synthetic oligonucleotide
tgtgtttttttgattgtg

SEQ ID NO: 13494 - DNA, 18 bp, Artificial Sequence
  Description of Artificial Sequence: Synthetic oligonucleotide
tgtaggttagtgagtgtg

SEQ ID NO: 13495 - DNA, 2 bp, Artificial Sequence
  Description of Artificial Sequence: Synthetic oligonucleotide
tg

SEQ ID NO: 13496 - DNA, 2 bp, Artificial Sequence
  Description of Artificial Sequence: Synthetic oligonucleotide
tg

SEQ ID NO: 13497 - DNA, 2 bp, Artificial Sequence
  Description of Artificial Sequence: Synthetic oligonucleotide
tg

SEQ ID NO: 13498 - DNA, 2 bp, Artificial Sequence
  Description of Artificial Sequence: Synthetic oligonucleotide
tg

SEQ ID NO: 13499 - DNA, 2 bp, Artificial Sequence
  Description of Artificial Sequence: Synthetic oligonucleotide
tg

SEQ ID NO: 13500 - DNA, 2 bp, Artificial Sequence
  Description of Artificial Sequence: Synthetic oligonucleotide
tg

SEQ ID NO: 13501 - DNA, 2 bp, Artificial Sequence
  Description of Artificial Sequence: Synthetic oligonucleotide
tg

SEQ ID NO: 13502 - DNA, 2 bp, Artificial Sequence
  Description of Artificial Sequence: Synthetic oligonucleotide
tg

SEQ ID NO: 13503 - DNA, 2 bp, Artificial Sequence
  Description of Artificial Sequence: Synthetic oligonucleotide
tg

SEQ ID NO: 13504 - DNA, 2 bp, Artificial Sequence
  Description of Artificial Sequence: Synthetic oligonucleotide
tg

SEQ ID NO: 13505 - DNA, 87 bp, Artificial Sequence
  Description of Artificial Sequence: Synthetic oligonucleotide
tgagttgaagtagggtgaggtattgttttatttgggaagtgtaaggggttagagagttttttttttgagttaaataaatgggtgatg

SEQ ID NO: 13506 - DNA, 2 bp, Artificial Sequence
  Description of Artificial Sequence: Synthetic oligonucleotide
tg

SEQ ID NO: 13507 - DNA, 2 bp, Artificial Sequence
  Description of Artificial Sequence: Synthetic oligonucleotide
tg

SEQ ID NO: 13508 - DNA, 2 bp, Artificial Sequence
  Description of Artificial Sequence: Synthetic oligonucleotide
tg

SEQ ID NO: 13509 - DNA, 2 bp, Artificial Sequence
  Description of Artificial Sequence: Synthetic oligonucleotide
tg

SEQ ID NO: 13510 - DNA, 2 bp, Artificial Sequence
  Description of Artificial Sequence: Synthetic oligonucleotide
tg

SEQ ID NO: 13511 - DNA, 2 bp, Artificial Sequence
  Description of Artificial Sequence: Synthetic oligonucleotide
tg

SEQ ID NO: 13512 - DNA, 2 bp, Artificial Sequence
  Description of Artificial Sequence: Synthetic oligonucleotide
tg

SEQ ID NO: 13513 - DNA, 2 bp, Artificial Sequence
  Description of Artificial Sequence: Synthetic oligonucleotide
tg

SEQ ID NO: 13514 - DNA, 2 bp, Artificial Sequence
  Description of Artificial Sequence: Synthetic oligonucleotide
tg

SEQ ID NO: 13515 - DNA, 2 bp, Artificial Sequence
  Description of Artificial Sequence: Synthetic oligonucleotide
tg

SEQ ID NO: 13516 - DNA, 11 bp, Artificial Sequence
  Description of Artificial Sequence: Synthetic oligonucleotide
tggagtttgtg

SEQ ID NO: 13517 - DNA, 2 bp, Artificial Sequence
  Description of Artificial Sequence: Synthetic oligonucleotide
tg

SEQ ID NO: 13518 - DNA, 2 bp, Artificial Sequence
  Description of Artificial Sequence: Synthetic oligonucleotide
tg

SEQ ID NO: 13519 - DNA, 2 bp, Artificial Sequence
  Description of Artificial Sequence: Synthetic oligonucleotide
tg

SEQ ID NO: 13520 - DNA, 2 bp, Artificial Sequence
  Description of Artificial Sequence: Synthetic oligonucleotide
tg

SEQ ID NO: 13521 - DNA, 2 bp, Artificial Sequence
  Description of Artificial Sequence: Synthetic oligonucleotide
tg

SEQ ID NO: 13522 - DNA, 2 bp, Artificial Sequence
  Description of Artificial Sequence: Synthetic oligonucleotide
tg

SEQ ID NO: 13523 - DNA, 2 bp, Artificial Sequence
  Description of Artificial Sequence: Synthetic oligonucleotide
tg

SEQ ID NO: 13524 - DNA, 2 bp, Artificial Sequence
  Description of Artificial Sequence: Synthetic oligonucleotide
tg

SEQ ID NO: 13525 - DNA, 2 bp, Artificial Sequence
  Description of Artificial Sequence: Synthetic oligonucleotide
tg

SEQ ID NO: 13526 - DNA, 2 bp, Artificial Sequence
  Description of Artificial Sequence: Synthetic oligonucleotide
tg

SEQ ID NO: 13527 - DNA, 2 bp, Artificial Sequence
  Description of Artificial Sequence: Synthetic oligonucleotide
tg

SEQ ID NO: 13528 - DNA, 2 bp, Artificial Sequence
  Description of Artificial Sequence: Synthetic oligonucleotide
tg

SEQ ID NO: 13529 - DNA, 2 bp, Artificial Sequence
  Description of Artificial Sequence: Synthetic oligonucleotide
tg

SEQ ID NO: 13530 - DNA, 2 bp, Artificial Sequence
  Description of Artificial Sequence: Synthetic oligonucleotide
tg

SEQ ID NO: 13531 - DNA, 2 bp, Artificial Sequence
  Description of Artificial Sequence: Synthetic oligonucleotide
tg

SEQ ID NO: 13532 - DNA, 2 bp, Artificial Sequence
  Description of Artificial Sequence: Synthetic oligonucleotide
tg

SEQ ID NO: 13533 - DNA, 2 bp, Artificial Sequence
  Description of Artificial Sequence: Synthetic oligonucleotide
tg

SEQ ID NO: 13534 - DNA, 2 bp, Artificial Sequence
  Description of Artificial Sequence: Synthetic oligonucleotide
tg

SEQ ID NO: 13535 - DNA, 2 bp, Artificial Sequence
  Description of Artificial Sequence: Synthetic oligonucleotide
tg

SEQ ID NO: 13536 - DNA, 167 bp, Artificial Sequence
  Description of Artificial Sequence: Synthetic polynucleotide
tgtattgtgggtgagttgaagtagggtgaggtattgttttatttgggaagtgttaggggttagggagttttttttttgagttaaggaaaggggtgattgatgtatttagaaaattgggttatttttatttgaatattgtgttttttagattggtttaaaaaatggtg

SEQ ID NO: 13537 - DNA, 2 bp, Artificial Sequence
  Description of Artificial Sequence: Synthetic oligonucleotide
tg

SEQ ID NO: 13538 - DNA, 2 bp, Artificial Sequence
  Description of Artificial Sequence: Synthetic oligonucleotide
tg

SEQ ID NO: 13539 - DNA, 2 bp, Artificial Sequence
  Description of Artificial Sequence: Synthetic oligonucleotide
tg

SEQ ID NO: 13540 - DNA, 185 bp, Artificial Sequence
  Description of Artificial Sequence: Synthetic polynucleotide
tgttgaatgtttaggattgtgaggtttttgtggaggttttgtgttttgttaaatgttattgtaagtgttgtgttattgagtatattaatttggtttttttttgaagggatagagtttatttggtgttgtatttatataaatttgaataaagtaaatttttttaaaagtagtgtatgtaagtattg

SEQ ID NO: 13541 - DNA, 17 bp, Artificial Sequence
  Description of Artificial Sequence: Synthetic oligonucleotide
tgagttgaagtagggtg

SEQ ID NO: 13542 - DNA, 135 bp, Artificial Sequence
  Description of Artificial Sequence: Synthetic polynucleotide
tgtgtgtgagttgaagtagggtaaggtaatgttttatttgggaagtgttaggggttagggagtttttttttttagttaaagaaaggggtgatggatgtatttggaaaattgggttatttttatttgaatattgtg

SEQ ID NO: 13543 - DNA, 2 bp, Artificial Sequence
  Description of Artificial Sequence: Synthetic oligonucleotide
tg

SEQ ID NO: 13544 - DNA, 71 bp, Artificial Sequence
  Description of Artificial Sequence: Synthetic oligonucleotide
tgtttgtttttggtgtttttttggttttggtatttattttggttgtgtttgaggagttttttagtttgttg

SEQ ID NO: 13545 - DNA, 54 bp, Artificial Sequence
  Description of Artificial Sequence: Synthetic oligonucleotide
tgtgtattgtgtgtgagttgaagtagggtgaggtattgttttatttgggaagtg

SEQ ID NO: 13546 - DNA, 5 bp, Artificial Sequence
  Description of Artificial Sequence: Synthetic oligonucleotide
tggtg

SEQ ID NO: 13547 - DNA, 29 bp, Artificial Sequence
  Description of Artificial Sequence: Synthetic oligonucleotide
tgttggtttttaagtttgtaggaaaagtg

SEQ ID NO: 13548 - DNA, 18 bp, Artificial Sequence
  Description of Artificial Sequence: Synthetic oligonucleotide
tgttttttagtgtttgtg

SEQ ID NO: 13549 - DNA, 2 bp, Artificial Sequence
  Description of Artificial Sequence: Synthetic oligonucleotide
tg

SEQ ID NO: 13550 - DNA, 5 bp, Artificial Sequence
  Description of Artificial Sequence: Synthetic oligonucleotide
tgatg

SEQ ID NO: 13551 - DNA, 24 bp, Artificial Sequence
  Description of Artificial Sequence: Synthetic oligonucleotide
tgaagtgttttttgtgtagatttg

SEQ ID NO: 13552 - DNA, 2 bp, Artificial Sequence
  Description of Artificial Sequence: Synthetic oligonucleotide
tg

SEQ ID NO: 13553 - DNA, 4 bp, Artificial Sequence
  Description of Artificial Sequence: Synthetic oligonucleotide
tgtg

SEQ ID NO: 13554 - DNA, 2 bp, Artificial Sequence
  Description of Artificial Sequence: Synthetic oligonucleotide
tg

SEQ ID NO: 13555 - DNA, 2 bp, Artificial Sequence
  Description of Artificial Sequence: Synthetic oligonucleotide
tg

SEQ ID NO: 13556 - DNA, 2 bp, Artificial Sequence
  Description of Artificial Sequence: Synthetic oligonucleotide
tg

SEQ ID NO: 13557 - DNA, 2 bp, Artificial Sequence
  Description of Artificial Sequence: Synthetic oligonucleotide
tg

SEQ ID NO: 13558 - DNA, 2 bp, Artificial Sequence
  Description of Artificial Sequence: Synthetic oligonucleotide
tg

SEQ ID NO: 13559 - DNA, 2 bp, Artificial Sequence
  Description of Artificial Sequence: Synthetic oligonucleotide
tg

SEQ ID NO: 13560 - DNA, 2 bp, Artificial Sequence
  Description of Artificial Sequence: Synthetic oligonucleotide
tg

SEQ ID NO: 13561 - DNA, 2 bp, Artificial Sequence
  Description of Artificial Sequence: Synthetic oligonucleotide
tg

SEQ ID NO: 13562 - DNA, 2 bp, Artificial Sequence
  Description of Artificial Sequence: Synthetic oligonucleotide
tg

SEQ ID NO: 13563 - DNA, 2 bp, Artificial Sequence
  Description of Artificial Sequence: Synthetic oligonucleotide
tg

SEQ ID NO: 13564 - DNA, 12 bp, Artificial Sequence
  Description of Artificial Sequence: Synthetic oligonucleotide
tggggtaggttg

SEQ ID NO: 13565 - DNA, 2 bp, Artificial Sequence
  Description of Artificial Sequence: Synthetic oligonucleotide
tg

SEQ ID NO: 13566 - DNA, 2 bp, Artificial Sequence
  Description of Artificial Sequence: Synthetic oligonucleotide
tg

SEQ ID NO: 13567 - DNA, 2 bp, Artificial Sequence
  Description of Artificial Sequence: Synthetic oligonucleotide
tg

SEQ ID NO: 13568 - DNA, 2 bp, Artificial Sequence
  Description of Artificial Sequence: Synthetic oligonucleotide
tg

SEQ ID NO: 13569 - DNA, 2 bp, Artificial Sequence
  Description of Artificial Sequence: Synthetic oligonucleotide
tg

SEQ ID NO: 13570 - DNA, 2 bp, Artificial Sequence
  Description of Artificial Sequence: Synthetic oligonucleotide
tg

SEQ ID NO: 13571 - DNA, 2 bp, Artificial Sequence
  Description of Artificial Sequence: Synthetic oligonucleotide
tg

SEQ ID NO: 13572 - DNA, 2 bp, Artificial Sequence
  Description of Artificial Sequence: Synthetic oligonucleotide
tg

SEQ ID NO: 13573 - DNA, 2 bp, Artificial Sequence
  Description of Artificial Sequence: Synthetic oligonucleotide
tg

SEQ ID NO: 13574 - DNA, 2 bp, Artificial Sequence
  Description of Artificial Sequence: Synthetic oligonucleotide
tg

SEQ ID NO: 13575 - DNA, 2 bp, Artificial Sequence
  Description of Artificial Sequence: Synthetic oligonucleotide
tg

SEQ ID NO: 13576 - DNA, 2 bp, Artificial Sequence
  Description of Artificial Sequence: Synthetic oligonucleotide
tg

SEQ ID NO: 13577 - DNA, 2 bp, Artificial Sequence
  Description of Artificial Sequence: Synthetic oligonucleotide
tg

SEQ ID NO: 13578 - DNA, 2 bp, Artificial Sequence
  Description of Artificial Sequence: Synthetic oligonucleotide
tg

SEQ ID NO: 13579 - DNA, 2 bp, Artificial Sequence
  Description of Artificial Sequence: Synthetic oligonucleotide
tg

SEQ ID NO: 13580 - DNA, 2 bp, Artificial Sequence
  Description of Artificial Sequence: Synthetic oligonucleotide
tg

SEQ ID NO: 13581 - DNA, 2 bp, Artificial Sequence
  Description of Artificial Sequence: Synthetic oligonucleotide
tg

SEQ ID NO: 13582 - DNA, 2 bp, Artificial Sequence
  Description of Artificial Sequence: Synthetic oligonucleotide
tg

SEQ ID NO: 13583 - DNA, 2 bp, Artificial Sequence
  Description of Artificial Sequence: Synthetic oligonucleotide
tg

SEQ ID NO: 13584 - DNA, 2 bp, Artificial Sequence
  Description of Artificial Sequence: Synthetic oligonucleotide
tg

SEQ ID NO: 13585 - DNA, 2 bp, Artificial Sequence
  Description of Artificial Sequence: Synthetic oligonucleotide
tg

SEQ ID NO: 13586 - DNA, 80 bp, Artificial Sequence
  Description of Artificial Sequence: Synthetic oligonucleotide
tgtatttgtgttaggagtatggatttatttagggagtgtttgggtggagaagtagtttttgttttaggttttttgttgtg

SEQ ID NO: 13587 - DNA, 2 bp, Artificial Sequence
  Description of Artificial Sequence: Synthetic oligonucleotide
tg

SEQ ID NO: 13588 - DNA, 2 bp, Artificial Sequence
  Description of Artificial Sequence: Synthetic oligonucleotide
tg

SEQ ID NO: 13589 - DNA, 2 bp, Artificial Sequence
  Description of Artificial Sequence: Synthetic oligonucleotide
tg

SEQ ID NO: 13590 - DNA, 2 bp, Artificial Sequence
  Description of Artificial Sequence: Synthetic oligonucleotide
tg

SEQ ID NO: 13591 - DNA, 2 bp, Artificial Sequence
  Description of Artificial Sequence: Synthetic oligonucleotide
tg

SEQ ID NO: 13592 - DNA, 2 bp, Artificial Sequence
  Description of Artificial Sequence: Synthetic oligonucleotide
tg

SEQ ID NO: 13593 - DNA, 2 bp, Artificial Sequence
  Description of Artificial Sequence: Synthetic oligonucleotide
tg

SEQ ID NO: 13594 - DNA, 2 bp, Artificial Sequence
  Description of Artificial Sequence: Synthetic oligonucleotide
tg

SEQ ID NO: 13595 - DNA, 2 bp, Artificial Sequence
  Description of Artificial Sequence: Synthetic oligonucleotide
tg

SEQ ID NO: 13596 - DNA, 2 bp, Artificial Sequence
  Description of Artificial Sequence: Synthetic oligonucleotide
tg

SEQ ID NO: 13597 - DNA, 4 bp, Artificial Sequence
  Description of Artificial Sequence: Synthetic oligonucleotide
tgtg

SEQ ID NO: 13598 - DNA, 2 bp, Artificial Sequence
  Description of Artificial Sequence: Synthetic oligonucleotide
tg

SEQ ID NO: 13599 - DNA, 2 bp, Artificial Sequence
  Description of Artificial Sequence: Synthetic oligonucleotide
tg

SEQ ID NO: 13600 - DNA, 2 bp, Artificial Sequence
  Description of Artificial Sequence: Synthetic oligonucleotide
tg

SEQ ID NO: 13601 - DNA, 2 bp, Artificial Sequence
  Description of Artificial Sequence: Synthetic oligonucleotide
tg

SEQ ID NO: 13602 - DNA, 2 bp, Artificial Sequence
  Description of Artificial Sequence: Synthetic oligonucleotide
tg

SEQ ID NO: 13603 - DNA, 2 bp, Artificial Sequence
  Description of Artificial Sequence: Synthetic oligonucleotide
tg

SEQ ID NO: 13604 - DNA, 2 bp, Artificial Sequence
  Description of Artificial Sequence: Synthetic oligonucleotide
tg

SEQ ID NO: 13605 - DNA, 2 bp, Artificial Sequence
  Description of Artificial Sequence: Synthetic oligonucleotide
tg

SEQ ID NO: 13606 - DNA, 2 bp, Artificial Sequence
  Description of Artificial Sequence: Synthetic oligonucleotide
tg

SEQ ID NO: 13607 - DNA, 2 bp, Artificial Sequence
  Description of Artificial Sequence: Synthetic oligonucleotide
tg

SEQ ID NO: 13608 - DNA, 3039 bp, Artificial Sequence
  Description of Artificial Sequence: Synthetic polynucleotide
tgttagatttggggttgttgtggagtttttgatttgaatttagggtgtgtgttgtgtttatggggggatattttaaagtggtaagaatgttttttgggaagggaataggatgttaggtttgaaaggggattttgaagtagtttaggaaaaaattttttatggattatggtgtttttttggtagtttttttgttaggtttgagggggttgttgtgttttaggtttgtatttagggttttatggggggtattttaaagtggtaagtaggtttttaggggaaggggatagtatgttaggtttggagggggatgttgaggtagttttgggaataaagaggggatgttggggttttgttatggataatattgtttttttgatagtatttgtggtgggtttgggagtgttatggagtttttggtttgtatttaaggtgtgtgttttgtttttggggggtattataaagtggtaagaaggttattgggggaagggtatgggatgttagggttgaaagggatagttgaggtagtttggggaaaaatgtggtaggttggggttgttttatggatgatagtgtttttttagtagtttttgtgttaggtttggggtggttgtggagtttttggtttgtattgagggtgtgggttgtatttatgggggtattttaaagtggtaagaaggttgttgggtgaatgttatagaaggttaggttttaatggggatgttgaggtagtatagagagaaaagtggttagttgggttttttttatggatgatagtgtttttttggtagtttttgtgttgggtttggggggattgtggagtttttattttgtatttagggtgtgtgttttgtttatgggaggtattttaaagtggtaagtaggtttttgggggaaggggatagtattttagatttgaagggggattttgaggtagtttgtggaaaaaaatggtgatgttgagttttttttataaatgatagtgtttttttggtagtttttttgttgggttagggtggttttggagtttgtggtttgtatttagggtgtgtgttttgtttaagggggtattttaaagtggtaagtagatttttgggggaagggagagtatgttaggtttgaaggggaggttgaggtggttttggggtaaaagtggtgaagttggggtttttttatggatgatattgtttttttggtagtttttgtagtgggtttagaggtgttgtggagtttttggtttgtttttaggttgtgtgttttgtttatgagtggtattataaagtagtaagaaggtttttaggggaagggtataggattttagggttgaaaggtagagttgaggtagattggtgttattttaaggataatagtgttttgtttggtagtttttgtattgggtttggggtggttgtggagtttttggtttgtatttggggtgtgtgttgtgtttatgatgggtattgtaatgtggtaagaagtttttgagtggaagggaataggatgttgagtttgaaaggggatgttgaggtagtttggggaaaaaatttttattgagaatagtgtttttttggtagtttttgagtgggatttaggtggatggtggagtttttggtttggatttagggtgtttgttttgtttatggggtgtatgtgaaagtggtaatagggtttttgggggaaggggataatatgttaggtttgaagagggatgttgggttagttagaggaaaatagtggttaggttgtggttgttttatagattatagtgtttttttggtagtttttgagtttggtttaggtgggggggtttggagtttttgttttgtaatagagtgtgtgttttgtttaagtgtgtatgtgaaagttgtaagaagggttttgggggaagggaataggatgttaggtttgaaaggggattttgaggtagtttagggaaaaattttttatggaggatagtgattttttgatattttttgtgtttggttttgggggttttggagtttttggtttatatttagggtgtgtgttttgtttatgggtggtattttaaagtagtaagaaagttttggggggggaagaataggatgttagatttgaaaggggatgttgaggtagtttaggaaaaaaaggggtgaggttggggtttttttatggatgatagtgttttttttatagtttttatgttagttttgggagggttgtggagtttttgttttgtatataatgtgtgtgttttgtttatggggggtattttaaagtggtaagaagttttttgtgggaaggtaataggatgttaggtttgaatggggatgtttaggtagtttggagaaaaaagtagtgaggttggggtgattttatgaatgatagtgttttattggtagtttttttgttgggtatgtgggggttgttgattttttggtttgtatttagggtgagtgttttgtttatggtgggtattataaagtagtaagaaggtttttgggggaaagggatagtatgttagttttgaagggggaagttgaggtagttttggggaaaaaaagtggggatgttggggtttttttatggatgatattgtttttttagtagtttttgtagtgggtttgggagtgttttggagtttttgttttgtattttgggtgtgtgttttatttatggggagtattataaagtggtaagaaggttattgggggaagggtataggatgttagggttgaaggggatagtggagatagtttaaggaaaaaagtggtgggatggtgttgttttaaggatggttatttttgtgttgggttagggatggttgtggagtttttggtttgtatttaggttgtgtgttttgtttatagggggtattttaaagtagtatgaaggtttttaggggaagggaagaggatgttaggtttggaaggtgatgttgaggtagtagggggtaaaaagtggtgggttgggtttttttatggatgatagtgtttttttggaagttgttgtgtagggtttggtgtgtttgtggagtttttggtttgtatttagaattgtgtg

SEQ ID NO: 13609 - DNA, 2 bp, Artificial Sequence
  Description of Artificial Sequence: Synthetic oligonucleotide
tg

SEQ ID NO: 13610 - DNA, 2 bp, Artificial Sequence
  Description of Artificial Sequence: Synthetic oligonucleotide
tg

SEQ ID NO: 13611 - DNA, 2 bp, Artificial Sequence
  Description of Artificial Sequence: Synthetic oligonucleotide
tg

SEQ ID NO: 13612 - DNA, 2 bp, Artificial Sequence
  Description of Artificial Sequence: Synthetic oligonucleotide
tg

SEQ ID NO: 13613 - DNA, 2 bp, Artificial Sequence
  Description of Artificial Sequence: Synthetic oligonucleotide
tg

SEQ ID NO: 13614 - DNA, 2 bp, Artificial Sequence
  Description of Artificial Sequence: Synthetic oligonucleotide
tg

SEQ ID NO: 13615 - DNA, 2 bp, Artificial Sequence
  Description of Artificial Sequence: Synthetic oligonucleotide
tg

SEQ ID NO: 13616 - DNA, 2 bp, Artificial Sequence
  Description of Artificial Sequence: Synthetic oligonucleotide
tg

SEQ ID NO: 13617 - DNA, 2 bp, Artificial Sequence
  Description of Artificial Sequence: Synthetic oligonucleotide
tg

SEQ ID NO: 13618 - DNA, 2 bp, Artificial Sequence
  Description of Artificial Sequence: Synthetic oligonucleotide
tg

SEQ ID NO: 13619 - DNA, 2 bp, Artificial Sequence
  Description of Artificial Sequence: Synthetic oligonucleotide
yg

SEQ ID NO: 13620 - DNA, 9 bp, Artificial Sequence
  Description of Artificial Sequence: Synthetic oligonucleotide
ygttattyg

SEQ ID NO: 13621 - DNA, 2 bp, Artificial Sequence
  Description of Artificial Sequence: Synthetic oligonucleotide
yg

SEQ ID NO: 13622 - DNA, 2 bp, Artificial Sequence
  Description of Artificial Sequence: Synthetic oligonucleotide
yg

SEQ ID NO: 13623 - DNA, 2 bp, Artificial Sequence
  Description of Artificial Sequence: Synthetic oligonucleotide
yg

SEQ ID NO: 13624 - DNA, 2 bp, Artificial Sequence
  Description of Artificial Sequence: Synthetic oligonucleotide
yg

SEQ ID NO: 13625 - DNA, 2 bp, Artificial Sequence
  Description of Artificial Sequence: Synthetic oligonucleotide
yg

SEQ ID NO: 13626 - DNA, 2 bp, Artificial Sequence
  Description of Artificial Sequence: Synthetic oligonucleotide
yg

SEQ ID NO: 13627 - DNA, 2 bp, Artificial Sequence
  Description of Artificial Sequence: Synthetic oligonucleotide
yg

SEQ ID NO: 13628 - DNA, 2 bp, Artificial Sequence
  Description of Artificial Sequence: Synthetic oligonucleotide
yg

SEQ ID NO: 13629 - DNA, 2 bp, Artificial Sequence
  Description of Artificial Sequence: Synthetic oligonucleotide
yg

SEQ ID NO: 13630 - DNA, 2 bp, Artificial Sequence
  Description of Artificial Sequence: Synthetic oligonucleotide
yg

SEQ ID NO: 13631 - DNA, 36 bp, Artificial Sequence
  Description of Artificial Sequence: Synthetic oligonucleotide
ygtaggttagtgggtgygygtattttgygtgagtyg

SEQ ID NO: 13632 - DNA, 2 bp, Artificial Sequence
  Description of Artificial Sequence: Synthetic oligonucleotide
yg

SEQ ID NO: 13633 - DNA, 2 bp, Artificial Sequence
  Description of Artificial Sequence: Synthetic oligonucleotide
yg

SEQ ID NO: 13634 - DNA, 2 bp, Artificial Sequence
  Description of Artificial Sequence: Synthetic oligonucleotide
yg

SEQ ID NO: 13635 - DNA, 2 bp, Artificial Sequence
  Description of Artificial Sequence: Synthetic oligonucleotide
yg

SEQ ID NO: 13636 - DNA, 2 bp, Artificial Sequence
  Description of Artificial Sequence: Synthetic oligonucleotide
yg

SEQ ID NO: 13637 - DNA, 2 bp, Artificial Sequence
  Description of Artificial Sequence: Synthetic oligonucleotide
yg

SEQ ID NO: 13638 - DNA, 2 bp, Artificial Sequence
  Description of Artificial Sequence: Synthetic oligonucleotide
yg

SEQ ID NO: 13639 - DNA, 2 bp, Artificial Sequence
  Description of Artificial Sequence: Synthetic oligonucleotide
yg

SEQ ID NO: 13640 - DNA, 2 bp, Artificial Sequence
  Description of Artificial Sequence: Synthetic oligonucleotide
yg

SEQ ID NO: 13641 - DNA, 2 bp, Artificial Sequence
  Description of Artificial Sequence: Synthetic oligonucleotide
yg

SEQ ID NO: 13642 - DNA, 8 bp, Artificial Sequence
  Description of Artificial Sequence: Synthetic oligonucleotide
ygtygtyg

SEQ ID NO: 13643 - DNA, 2 bp, Artificial Sequence
  Description of Artificial Sequence: Synthetic oligonucleotide
yg

SEQ ID NO: 13644 - DNA, 2 bp, Artificial Sequence
  Description of Artificial Sequence: Synthetic oligonucleotide
yg

SEQ ID NO: 13645 - DNA, 2 bp, Artificial Sequence
  Description of Artificial Sequence: Synthetic oligonucleotide
yg

SEQ ID NO: 13646 - DNA, 2 bp, Artificial Sequence
  Description of Artificial Sequence: Synthetic oligonucleotide
yg

SEQ ID NO: 13647 - DNA, 2 bp, Artificial Sequence
  Description of Artificial Sequence: Synthetic oligonucleotide
yg

SEQ ID NO: 13648 - DNA, 2 bp, Artificial Sequence
  Description of Artificial Sequence: Synthetic oligonucleotide
yg

SEQ ID NO: 13649 - DNA, 2 bp, Artificial Sequence
  Description of Artificial Sequence: Synthetic oligonucleotide
yg

SEQ ID NO: 13650 - DNA, 2 bp, Artificial Sequence
  Description of Artificial Sequence: Synthetic oligonucleotide
yg

SEQ ID NO: 13651 - DNA, 2 bp, Artificial Sequence
  Description of Artificial Sequence: Synthetic oligonucleotide
yg

SEQ ID NO: 13652 - DNA, 2 bp, Artificial Sequence
  Description of Artificial Sequence: Synthetic oligonucleotide
yg

SEQ ID NO: 13653 - DNA, 181 bp, Artificial Sequence
  Description of Artificial Sequence: Synthetic polynucleotide
ygatttttttgttttagtttttygagtagttgggattataggtataygttattaygtttagttaatttttgtttgtttgtttatttatttattattatttttgagayggagtttygttttgttattaggttggagtgttattggagtgtaatggtaygatttyggtttattgtaattttyg

SEQ ID NO: 13654 - DNA, 2 bp, Artificial Sequence
  Description of Artificial Sequence: Synthetic oligonucleotide
yg

SEQ ID NO: 13655 - DNA, 2 bp, Artificial Sequence
  Description of Artificial Sequence: Synthetic oligonucleotide
yg

SEQ ID NO: 13656 - DNA, 2 bp, Artificial Sequence
  Description of Artificial Sequence: Synthetic oligonucleotide
yg

SEQ ID NO: 13657 - DNA, 2 bp, Artificial Sequence
  Description of Artificial Sequence: Synthetic oligonucleotide
yg

SEQ ID NO: 13658 - DNA, 2 bp, Artificial Sequence
  Description of Artificial Sequence: Synthetic oligonucleotide
yg

SEQ ID NO: 13659 - DNA, 2 bp, Artificial Sequence
  Description of Artificial Sequence: Synthetic oligonucleotide
yg

SEQ ID NO: 13660 - DNA, 2 bp, Artificial Sequence
  Description of Artificial Sequence: Synthetic oligonucleotide
yg

SEQ ID NO: 13661 - DNA, 2 bp, Artificial Sequence
  Description of Artificial Sequence: Synthetic oligonucleotide
yg

SEQ ID NO: 13662 - DNA, 2 bp, Artificial Sequence
  Description of Artificial Sequence: Synthetic oligonucleotide
yg

SEQ ID NO: 13663 - DNA, 2 bp, Artificial Sequence
  Description of Artificial Sequence: Synthetic oligonucleotide
yg

SEQ ID NO: 13664 - DNA, 369 bp, Artificial Sequence
  Description of Artificial Sequence: Synthetic polynucleotide
yggggaggtttgggttgtataggagygtayggygggggtggaggtttaggtatggagggttgtaggtttygagttttgttyggyggggaggtagttaaggtttagygagaagtygagtatagtagttgttggtttaggtgttaagttttttattgttygggtyggttggtygtttygagtgyggggtttgttaagtttaygtttattyggaattygagttggttygtaagygtagtttgtagttayggttttygtttaygtttttttttttatatttattygtaagttgagggagtyggttttagttttgtttagtttagaaaggggtttttatagtgtagygaygggttgaagggttttttaaaygyg

SEQ ID NO: 13665 - DNA, 2 bp, Artificial Sequence
  Description of Artificial Sequence: Synthetic oligonucleotide
yg

SEQ ID NO: 13666 - DNA, 2 bp, Artificial Sequence
  Description of Artificial Sequence: Synthetic oligonucleotide
yg

SEQ ID NO: 13667 - DNA, 2 bp, Artificial Sequence
  Description of Artificial Sequence: Synthetic oligonucleotide
yg

SEQ ID NO: 13668 - DNA, 2 bp, Artificial Sequence
  Description of Artificial Sequence: Synthetic oligonucleotide
yg

SEQ ID NO: 13669 - DNA, 2 bp, Artificial Sequence
  Description of Artificial Sequence: Synthetic oligonucleotide
yg

SEQ ID NO: 13670 - DNA, 2 bp, Artificial Sequence
  Description of Artificial Sequence: Synthetic oligonucleotide
yg

SEQ ID NO: 13671 - DNA, 2 bp, Artificial Sequence
  Description of Artificial Sequence: Synthetic oligonucleotide
yg

SEQ ID NO: 13672 - DNA, 2 bp, Artificial Sequence
  Description of Artificial Sequence: Synthetic oligonucleotide
yg

SEQ ID NO: 13673 - DNA, 2 bp, Artificial Sequence
  Description of Artificial Sequence: Synthetic oligonucleotide
yg

SEQ ID NO: 13674 - DNA, 2 bp, Artificial Sequence
  Description of Artificial Sequence: Synthetic oligonucleotide
yg

SEQ ID NO: 13675 - DNA, 2 bp, Artificial Sequence
  Description of Artificial Sequence: Synthetic oligonucleotide
yg

SEQ ID NO: 13676 - DNA, 2 bp, Artificial Sequence
  Description of Artificial Sequence: Synthetic oligonucleotide
yg

SEQ ID NO: 13677 - DNA, 2 bp, Artificial Sequence
  Description of Artificial Sequence: Synthetic oligonucleotide
yg

SEQ ID NO: 13678 - DNA, 2 bp, Artificial Sequence
  Description of Artificial Sequence: Synthetic oligonucleotide
yg

SEQ ID NO: 13679 - DNA, 2 bp, Artificial Sequence
  Description of Artificial Sequence: Synthetic oligonucleotide
yg

SEQ ID NO: 13680 - DNA, 2 bp, Artificial Sequence
  Description of Artificial Sequence: Synthetic oligonucleotide
yg

SEQ ID NO: 13681 - DNA, 2 bp, Artificial Sequence
  Description of Artificial Sequence: Synthetic oligonucleotide
yg

SEQ ID NO: 13682 - DNA, 2 bp, Artificial Sequence
  Description of Artificial Sequence: Synthetic oligonucleotide
yg

SEQ ID NO: 13683 - DNA, 2 bp, Artificial Sequence
  Description of Artificial Sequence: Synthetic oligonucleotide
yg

SEQ ID NO: 13684 - DNA, 2 bp, Artificial Sequence
  Description of Artificial Sequence: Synthetic oligonucleotide
yg

SEQ ID NO: 13685 - DNA, 2 bp, Artificial Sequence
  Description of Artificial Sequence: Synthetic oligonucleotide
yg

SEQ ID NO: 13686 - DNA, 35 bp, Artificial Sequence
  Description of Artificial Sequence: Synthetic oligonucleotide
yggtagtaaatgaagtygaggtagtggtgtaagyg

SEQ ID NO: 13687 - DNA, 2 bp, Artificial Sequence
  Description of Artificial Sequence: Synthetic oligonucleotide
yg

SEQ ID NO: 13688 - DNA, 2 bp, Artificial Sequence
  Description of Artificial Sequence: Synthetic oligonucleotide
yg

SEQ ID NO: 13689 - DNA, 2 bp, Artificial Sequence
  Description of Artificial Sequence: Synthetic oligonucleotide
yg

SEQ ID NO: 13690 - DNA, 2 bp, Artificial Sequence
  Description of Artificial Sequence: Synthetic oligonucleotide
yg

SEQ ID NO: 13691 - DNA, 2 bp, Artificial Sequence
  Description of Artificial Sequence: Synthetic oligonucleotide
yg

SEQ ID NO: 13692 - DNA, 2 bp, Artificial Sequence
  Description of Artificial Sequence: Synthetic oligonucleotide
yg

SEQ ID NO: 13693 - DNA, 2 bp, Artificial Sequence
  Description of Artificial Sequence: Synthetic oligonucleotide
yg

SEQ ID NO: 13694 - DNA, 2 bp, Artificial Sequence
  Description of Artificial Sequence: Synthetic oligonucleotide
yg

SEQ ID NO: 13695 - DNA, 2 bp, Artificial Sequence
  Description of Artificial Sequence: Synthetic oligonucleotide
yg

SEQ ID NO: 13696 - DNA, 2 bp, Artificial Sequence
  Description of Artificial Sequence: Synthetic oligonucleotide
yg

SEQ ID NO: 13697 - DNA, 487 bp, Artificial Sequence
  Description of Artificial Sequence: Synthetic polynucleotide
ygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygtgagttttgttttgttttgtattaagtttgtattttttaggtttttggtatttttgtttttgggaygtggggtttttatagatttggaaatttttgtttgtttttttttatttagagtaaattgagaygtttataagagtttggaagttgtttttttttgggtttgaagtygtttggaggttggtttygttttyggtttttttgttatagggtaatgtatatattttttatygtatagtttttttgtttaaaattttgttgatttattttgttttttgttttttaaagtttttattygtgygttggattttygttttgggyg

SEQ ID NO: 13698 - DNA, 2 bp, Artificial Sequence
  Description of Artificial Sequence: Synthetic oligonucleotide
yg

SEQ ID NO: 13699 - DNA, 2 bp, Artificial Sequence
  Description of Artificial Sequence: Synthetic oligonucleotide
yg

SEQ ID NO: 13700 - DNA, 2 bp, Artificial Sequence
  Description of Artificial Sequence: Synthetic oligonucleotide
yg

SEQ ID NO: 13701 - DNA, 2 bp, Artificial Sequence
  Description of Artificial Sequence: Synthetic oligonucleotide
yg

SEQ ID NO: 13702 - DNA, 2 bp, Artificial Sequence
  Description of Artificial Sequence: Synthetic oligonucleotide
yg

SEQ ID NO: 13703 - DNA, 2 bp, Artificial Sequence
  Description of Artificial Sequence: Synthetic oligonucleotide
yg

SEQ ID NO: 13704 - DNA, 2 bp, Artificial Sequence
  Description of Artificial Sequence: Synthetic oligonucleotide
yg

SEQ ID NO: 13705 - DNA, 2 bp, Artificial Sequence
  Description of Artificial Sequence: Synthetic oligonucleotide
yg

SEQ ID NO: 13706 - DNA, 2 bp, Artificial Sequence
  Description of Artificial Sequence: Synthetic oligonucleotide
yg

SEQ ID NO: 13707 - DNA, 2 bp, Artificial Sequence
  Description of Artificial Sequence: Synthetic oligonucleotide
yg

SEQ ID NO: 13708 - DNA, 28 bp, Artificial Sequence
  Description of Artificial Sequence: Synthetic oligonucleotide
yggattaygaggttaggagattaagayg

SEQ ID NO: 13709 - DNA, 2 bp, Artificial Sequence
  Description of Artificial Sequence: Synthetic oligonucleotide
yg

SEQ ID NO: 13710 - DNA, 2 bp, Artificial Sequence
  Description of Artificial Sequence: Synthetic oligonucleotide
yg

SEQ ID NO: 13711 - DNA, 2 bp, Artificial Sequence
  Description of Artificial Sequence: Synthetic oligonucleotide
yg

SEQ ID NO: 13712 - DNA, 2 bp, Artificial Sequence
  Description of Artificial Sequence: Synthetic oligonucleotide
yg

SEQ ID NO: 13713 - DNA, 2 bp, Artificial Sequence
  Description of Artificial Sequence: Synthetic oligonucleotide
yg

SEQ ID NO: 13714 - DNA, 2 bp, Artificial Sequence
  Description of Artificial Sequence: Synthetic oligonucleotide
yg

SEQ ID NO: 13715 - DNA, 2 bp, Artificial Sequence
  Description of Artificial Sequence: Synthetic oligonucleotide
yg

SEQ ID NO: 13716 - DNA, 2 bp, Artificial Sequence
  Description of Artificial Sequence: Synthetic oligonucleotide
yg

SEQ ID NO: 13717 - DNA, 2 bp, Artificial Sequence
  Description of Artificial Sequence: Synthetic oligonucleotide
yg

SEQ ID NO: 13718 - DNA, 2 bp, Artificial Sequence
  Description of Artificial Sequence: Synthetic oligonucleotide
yg

SEQ ID NO: 13719 - DNA, 2 bp, Artificial Sequence
  Description of Artificial Sequence: Synthetic oligonucleotide
yg

SEQ ID NO: 13720 - DNA, 2 bp, Artificial Sequence
  Description of Artificial Sequence: Synthetic oligonucleotide
yg

SEQ ID NO: 13721 - DNA, 2 bp, Artificial Sequence
  Description of Artificial Sequence: Synthetic oligonucleotide
yg

SEQ ID NO: 13722 - DNA, 2 bp, Artificial Sequence
  Description of Artificial Sequence: Synthetic oligonucleotide
yg

SEQ ID NO: 13723 - DNA, 2 bp, Artificial Sequence
  Description of Artificial Sequence: Synthetic oligonucleotide
yg

SEQ ID NO: 13724 - DNA, 2 bp, Artificial Sequence
  Description of Artificial Sequence: Synthetic oligonucleotide
yg

SEQ ID NO: 13725 - DNA, 2 bp, Artificial Sequence
  Description of Artificial Sequence: Synthetic oligonucleotide
yg

SEQ ID NO: 13726 - DNA, 2 bp, Artificial Sequence
  Description of Artificial Sequence: Synthetic oligonucleotide
yg

SEQ ID NO: 13727 - DNA, 2 bp, Artificial Sequence
  Description of Artificial Sequence: Synthetic oligonucleotide
yg

SEQ ID NO: 13728 - DNA, 2 bp, Artificial Sequence
  Description of Artificial Sequence: Synthetic oligonucleotide
yg

SEQ ID NO: 13729 - DNA, 2 bp, Artificial Sequence
  Description of Artificial Sequence: Synthetic oligonucleotide
yg

SEQ ID NO: 13730 - DNA, 18 bp, Artificial Sequence
  Description of Artificial Sequence: Synthetic oligonucleotide
ygyggttaggaaggygyg

SEQ ID NO: 13731 - DNA, 18 bp, Artificial Sequence
  Description of Artificial Sequence: Synthetic oligonucleotide
ygtatttattgatttgyg

SEQ ID NO: 13732 - DNA, 2 bp, Artificial Sequence
  Description of Artificial Sequence: Synthetic oligonucleotide
yg

SEQ ID NO: 13733 - DNA, 2 bp, Artificial Sequence
  Description of Artificial Sequence: Synthetic oligonucleotide
yg

SEQ ID NO: 13734 - DNA, 2 bp, Artificial Sequence
  Description of Artificial Sequence: Synthetic oligonucleotide
yg

SEQ ID NO: 13735 - DNA, 2 bp, Artificial Sequence
  Description of Artificial Sequence: Synthetic oligonucleotide
yg

SEQ ID NO: 13736 - DNA, 2 bp, Artificial Sequence
  Description of Artificial Sequence: Synthetic oligonucleotide
yg

SEQ ID NO: 13737 - DNA, 2 bp, Artificial Sequence
  Description of Artificial Sequence: Synthetic oligonucleotide
yg

SEQ ID NO: 13738 - DNA, 2 bp, Artificial Sequence
  Description of Artificial Sequence: Synthetic oligonucleotide
yg

SEQ ID NO: 13739 - DNA, 2 bp, Artificial Sequence
  Description of Artificial Sequence: Synthetic oligonucleotide
yg

SEQ ID NO: 13740 - DNA, 2 bp, Artificial Sequence
  Description of Artificial Sequence: Synthetic oligonucleotide
yg

SEQ ID NO: 13741 - DNA, 2 bp, Artificial Sequence
  Description of Artificial Sequence: Synthetic oligonucleotide
yg

SEQ ID NO: 13742 - DNA, 87 bp, Artificial Sequence
  Description of Artificial Sequence: Synthetic oligonucleotide
ygttatttatttatttgattyggaaagggaattttttgattttttgygttttttaggtgaggtaatgtttygttttgtttyggttyg

SEQ ID NO: 13743 - DNA, 2 bp, Artificial Sequence
  Description of Artificial Sequence: Synthetic oligonucleotide
yg

SEQ ID NO: 13744 - DNA, 2 bp, Artificial Sequence
  Description of Artificial Sequence: Synthetic oligonucleotide
yg

SEQ ID NO: 13745 - DNA, 2 bp, Artificial Sequence
  Description of Artificial Sequence: Synthetic oligonucleotide
yg

SEQ ID NO: 13746 - DNA, 2 bp, Artificial Sequence
  Description of Artificial Sequence: Synthetic oligonucleotide
yg

SEQ ID NO: 13747 - DNA, 2 bp, Artificial Sequence
  Description of Artificial Sequence: Synthetic oligonucleotide
yg

SEQ ID NO: 13748 - DNA, 2 bp, Artificial Sequence
  Description of Artificial Sequence: Synthetic oligonucleotide
yg

SEQ ID NO: 13749 - DNA, 2 bp, Artificial Sequence
  Description of Artificial Sequence: Synthetic oligonucleotide
yg

SEQ ID NO: 13750 - DNA, 2 bp, Artificial Sequence
  Description of Artificial Sequence: Synthetic oligonucleotide
yg

SEQ ID NO: 13751 - DNA, 2 bp, Artificial Sequence
  Description of Artificial Sequence: Synthetic oligonucleotide
yg

SEQ ID NO: 13752 - DNA, 2 bp, Artificial Sequence
  Description of Artificial Sequence: Synthetic oligonucleotide
yg

SEQ ID NO: 13753 - DNA, 11 bp, Artificial Sequence
  Description of Artificial Sequence: Synthetic oligonucleotide
ygtaagtttyg

SEQ ID NO: 13754 - DNA, 2 bp, Artificial Sequence
  Description of Artificial Sequence: Synthetic oligonucleotide
yg

SEQ ID NO: 13755 - DNA, 2 bp, Artificial Sequence
  Description of Artificial Sequence: Synthetic oligonucleotide
yg

SEQ ID NO: 13756 - DNA, 2 bp, Artificial Sequence
  Description of Artificial Sequence: Synthetic oligonucleotide
yg

SEQ ID NO: 13757 - DNA, 2 bp, Artificial Sequence
  Description of Artificial Sequence: Synthetic oligonucleotide
yg

SEQ ID NO: 13758 - DNA, 2 bp, Artificial Sequence
  Description of Artificial Sequence: Synthetic oligonucleotide
yg

SEQ ID NO: 13759 - DNA, 2 bp, Artificial Sequence
  Description of Artificial Sequence: Synthetic oligonucleotide
yg

SEQ ID NO: 13760 - DNA, 2 bp, Artificial Sequence
  Description of Artificial Sequence: Synthetic oligonucleotide
yg

SEQ ID NO: 13761 - DNA, 2 bp, Artificial Sequence
  Description of Artificial Sequence: Synthetic oligonucleotide
yg

SEQ ID NO: 13762 - DNA, 2 bp, Artificial Sequence
  Description of Artificial Sequence: Synthetic oligonucleotide
yg

SEQ ID NO: 13763 - DNA, 2 bp, Artificial Sequence
  Description of Artificial Sequence: Synthetic oligonucleotide
yg

SEQ ID NO: 13764 - DNA, 2 bp, Artificial Sequence
  Description of Artificial Sequence: Synthetic oligonucleotide
yg

SEQ ID NO: 13765 - DNA, 2 bp, Artificial Sequence
  Description of Artificial Sequence: Synthetic oligonucleotide
yg

SEQ ID NO: 13766 - DNA, 2 bp, Artificial Sequence
  Description of Artificial Sequence: Synthetic oligonucleotide
yg

SEQ ID NO: 13767 - DNA, 2 bp, Artificial Sequence
  Description of Artificial Sequence: Synthetic oligonucleotide
yg

SEQ ID NO: 13768 - DNA, 2 bp, Artificial Sequence
  Description of Artificial Sequence: Synthetic oligonucleotide
yg

SEQ ID NO: 13769 - DNA, 2 bp, Artificial Sequence
  Description of Artificial Sequence: Synthetic oligonucleotide
yg

SEQ ID NO: 13770 - DNA, 2 bp, Artificial Sequence
  Description of Artificial Sequence: Synthetic oligonucleotide
yg

SEQ ID NO: 13771 - DNA, 2 bp, Artificial Sequence
  Description of Artificial Sequence: Synthetic oligonucleotide
yg

SEQ ID NO: 13772 - DNA, 2 bp, Artificial Sequence
  Description of Artificial Sequence: Synthetic oligonucleotide
yg

SEQ ID NO: 13773 - DNA, 167 bp, Artificial Sequence
  Description of Artificial Sequence: Synthetic polynucleotide
ygttattttttaagtyggtttgaaaagygtaatattygggtgggagtgattygattttttaggtgygtyggttatttttttttttgattyggaaagggaattttttgatttttggygttttttaggtgaggtaatgtttygttttgtttyggttygtttayggtgyg

SEQ ID NO: 13774 - DNA, 2 bp, Artificial Sequence
  Description of Artificial Sequence: Synthetic oligonucleotide
yg

SEQ ID NO: 13775 - DNA, 2 bp, Artificial Sequence
  Description of Artificial Sequence: Synthetic oligonucleotide
yg

SEQ ID NO: 13776 - DNA, 2 bp, Artificial Sequence
  Description of Artificial Sequence: Synthetic oligonucleotide
yg

SEQ ID NO: 13777 - DNA, 185 bp, Artificial Sequence
  Description of Artificial Sequence: Synthetic polynucleotide
yggtgtttatataygttgtttttaaaaaaatttgttttgtttaggtttgtgtgaatataaygtyggatgaattttgtttttttagaagaaagtygggttggtgtgttygatgaygtagygtttgtagtggygtttgataaagygtagggtttttayggagatttygtagttttggatatttagyg

SEQ ID NO: 13778 - DNA, 17 bp, Artificial Sequence
  Description of Artificial Sequence: Synthetic oligonucleotide
ygttttgtttyggttyg

SEQ ID NO: 13779 - DNA, 135 bp, Artificial Sequence
  Description of Artificial Sequence: Synthetic polynucleotide
ygtaatattygggtgggagtgattygattttttaggtgygttygttatttttttttttgattaggaaagggaattttttgatttttggygtttttygagtgaggtattgttttattttgtttyggttygygtayg

SEQ ID NO: 13780 - DNA, 2 bp, Artificial Sequence
  Description of Artificial Sequence: Synthetic oligonucleotide
yg

SEQ ID NO: 13781 - DNA, 71 bp, Artificial Sequence
  Description of Artificial Sequence: Synthetic oligonucleotide
yggygggttgaagggttttttaagygyggttagagtgggtgttaaggtygaggaggygttaagagygagyg

SEQ ID NO: 13782 - DNA, 54 bp, Artificial Sequence
  Description of Artificial Sequence: Synthetic oligonucleotide
ygttttttaagtgaggtaatgtttygttttgtttyggttygygtayggtgygyg

SEQ ID NO: 13783 - DNA, 5 bp, Artificial Sequence
  Description of Artificial Sequence: Synthetic oligonucleotide
ygtyg

SEQ ID NO: 13784 - DNA, 29 bp, Artificial Sequence
  Description of Artificial Sequence: Synthetic oligonucleotide
ygttttttttaygggtttaaaaatyggyg

SEQ ID NO: 13785 - DNA, 18 bp, Artificial Sequence
  Description of Artificial Sequence: Synthetic oligonucleotide
ygtagatattagaaagyg

SEQ ID NO: 13786 - DNA, 2 bp, Artificial Sequence
  Description of Artificial Sequence: Synthetic oligonucleotide
yg

SEQ ID NO: 13787 - DNA, 5 bp, Artificial Sequence
  Description of Artificial Sequence: Synthetic oligonucleotide
ygtyg

SEQ ID NO: 13788 - DNA, 24 bp, Artificial Sequence
  Description of Artificial Sequence: Synthetic oligonucleotide
ygagtttgygtaggaggygtttyg

SEQ ID NO: 13789 - DNA, 2 bp, Artificial Sequence
  Description of Artificial Sequence: Synthetic oligonucleotide
yg

SEQ ID NO: 13790 - DNA, 4 bp, Artificial Sequence
  Description of Artificial Sequence: Synthetic oligonucleotide
ygyg

SEQ ID NO: 13791 - DNA, 2 bp, Artificial Sequence
  Description of Artificial Sequence: Synthetic oligonucleotide
yg

SEQ ID NO: 13792 - DNA, 2 bp, Artificial Sequence
  Description of Artificial Sequence: Synthetic oligonucleotide
yg

SEQ ID NO: 13793 - DNA, 2 bp, Artificial Sequence
  Description of Artificial Sequence: Synthetic oligonucleotide
yg

SEQ ID NO: 13794 - DNA, 2 bp, Artificial Sequence
  Description of Artificial Sequence: Synthetic oligonucleotide
yg

SEQ ID NO: 13795 - DNA, 2 bp, Artificial Sequence
  Description of Artificial Sequence: Synthetic oligonucleotide
yg

SEQ ID NO: 13796 - DNA, 2 bp, Artificial Sequence
  Description of Artificial Sequence: Synthetic oligonucleotide
yg

SEQ ID NO: 13797 - DNA, 2 bp, Artificial Sequence
  Description of Artificial Sequence: Synthetic oligonucleotide
yg

SEQ ID NO: 13798 - DNA, 2 bp, Artificial Sequence
  Description of Artificial Sequence: Synthetic oligonucleotide
yg

SEQ ID NO: 13799 - DNA, 2 bp, Artificial Sequence
  Description of Artificial Sequence: Synthetic oligonucleotide
yg

SEQ ID NO: 13800 - DNA, 2 bp, Artificial Sequence
  Description of Artificial Sequence: Synthetic oligonucleotide
yg

SEQ ID NO: 13801 - DNA, 12 bp, Artificial Sequence
  Description of Artificial Sequence: Synthetic oligonucleotide
ygatttgtttyg

SEQ ID NO: 13802 - DNA, 2 bp, Artificial Sequence
  Description of Artificial Sequence: Synthetic oligonucleotide
yg

SEQ ID NO: 13803 - DNA, 2 bp, Artificial Sequence
  Description of Artificial Sequence: Synthetic oligonucleotide
yg

SEQ ID NO: 13804 - DNA, 2 bp, Artificial Sequence
  Description of Artificial Sequence: Synthetic oligonucleotide
yg

SEQ ID NO: 13805 - DNA, 2 bp, Artificial Sequence
  Description of Artificial Sequence: Synthetic oligonucleotide
yg

SEQ ID NO: 13806 - DNA, 2 bp, Artificial Sequence
  Description of Artificial Sequence: Synthetic oligonucleotide
yg

SEQ ID NO: 13807 - DNA, 2 bp, Artificial Sequence
  Description of Artificial Sequence: Synthetic oligonucleotide
yg

SEQ ID NO: 13808 - DNA, 2 bp, Artificial Sequence
  Description of Artificial Sequence: Synthetic oligonucleotide
yg

SEQ ID NO: 13809 - DNA, 2 bp, Artificial Sequence
  Description of Artificial Sequence: Synthetic oligonucleotide
yg

SEQ ID NO: 13810 - DNA, 2 bp, Artificial Sequence
  Description of Artificial Sequence: Synthetic oligonucleotide
yg

SEQ ID NO: 13811 - DNA, 2 bp, Artificial Sequence
  Description of Artificial Sequence: Synthetic oligonucleotide
yg

SEQ ID NO: 13812 - DNA, 2 bp, Artificial Sequence
  Description of Artificial Sequence: Synthetic oligonucleotide
yg

SEQ ID NO: 13813 - DNA, 2 bp, Artificial Sequence
  Description of Artificial Sequence: Synthetic oligonucleotide
yg

SEQ ID NO: 13814 - DNA, 2 bp, Artificial Sequence
  Description of Artificial Sequence: Synthetic oligonucleotide
yg

SEQ ID NO: 13815 - DNA, 2 bp, Artificial Sequence
  Description of Artificial Sequence: Synthetic oligonucleotide
yg

SEQ ID NO: 13816 - DNA, 2 bp, Artificial Sequence
  Description of Artificial Sequence: Synthetic oligonucleotide
yg

SEQ ID NO: 13817 - DNA, 2 bp, Artificial Sequence
  Description of Artificial Sequence: Synthetic oligonucleotide
yg

SEQ ID NO: 13818 - DNA, 2 bp, Artificial Sequence
  Description of Artificial Sequence: Synthetic oligonucleotide
yg

SEQ ID NO: 13819 - DNA, 2 bp, Artificial Sequence
  Description of Artificial Sequence: Synthetic oligonucleotide
yg

SEQ ID NO: 13820 - DNA, 2 bp, Artificial Sequence
  Description of Artificial Sequence: Synthetic oligonucleotide
yg

SEQ ID NO: 13821 - DNA, 2 bp, Artificial Sequence
  Description of Artificial Sequence: Synthetic oligonucleotide
yg

SEQ ID NO: 13822 - DNA, 2 bp, Artificial Sequence
  Description of Artificial Sequence: Synthetic oligonucleotide
yg

SEQ ID NO: 13823 - DNA, 80 bp, Artificial Sequence
  Description of Artificial Sequence: Synthetic oligonucleotide
ygtagyggaaggtttggagtagaggttgttttttygtttaagtattttttgggtgagtttatatttttggygygagtayg

SEQ ID NO: 13824 - DNA, 2 bp, Artificial Sequence
  Description of Artificial Sequence: Synthetic oligonucleotide
yg

SEQ ID NO: 13825 - DNA, 2 bp, Artificial Sequence
  Description of Artificial Sequence: Synthetic oligonucleotide
yg

SEQ ID NO: 13826 - DNA, 2 bp, Artificial Sequence
  Description of Artificial Sequence: Synthetic oligonucleotide
yg

SEQ ID NO: 13827 - DNA, 2 bp, Artificial Sequence
  Description of Artificial Sequence: Synthetic oligonucleotide
yg

SEQ ID NO: 13828 - DNA, 2 bp, Artificial Sequence
  Description of Artificial Sequence: Synthetic oligonucleotide
yg

SEQ ID NO: 13829 - DNA, 2 bp, Artificial Sequence
  Description of Artificial Sequence: Synthetic oligonucleotide
yg

SEQ ID NO: 13830 - DNA, 2 bp, Artificial Sequence
  Description of Artificial Sequence: Synthetic oligonucleotide
yg

SEQ ID NO: 13831 - DNA, 2 bp, Artificial Sequence
  Description of Artificial Sequence: Synthetic oligonucleotide
yg

SEQ ID NO: 13832 - DNA, 2 bp, Artificial Sequence
  Description of Artificial Sequence: Synthetic oligonucleotide
yg

SEQ ID NO: 13833 - DNA, 2 bp, Artificial Sequence
  Description of Artificial Sequence: Synthetic oligonucleotide
yg

SEQ ID NO: 13834 - DNA, 4 bp, Artificial Sequence
  Description of Artificial Sequence: Synthetic oligonucleotide
ygyg

SEQ ID NO: 13835 - DNA, 2 bp, Artificial Sequence
  Description of Artificial Sequence: Synthetic oligonucleotide
yg

SEQ ID NO: 13836 - DNA, 2 bp, Artificial Sequence
  Description of Artificial Sequence: Synthetic oligonucleotide
yg

SEQ ID NO: 13837 - DNA, 2 bp, Artificial Sequence
  Description of Artificial Sequence: Synthetic oligonucleotide
yg

SEQ ID NO: 13838 - DNA, 2 bp, Artificial Sequence
  Description of Artificial Sequence: Synthetic oligonucleotide
yg

SEQ ID NO: 13839 - DNA, 2 bp, Artificial Sequence
  Description of Artificial Sequence: Synthetic oligonucleotide
yg

SEQ ID NO: 13840 - DNA, 2 bp, Artificial Sequence
  Description of Artificial Sequence: Synthetic oligonucleotide
yg

SEQ ID NO: 13841 - DNA, 2 bp, Artificial Sequence
  Description of Artificial Sequence: Synthetic oligonucleotide
yg

SEQ ID NO: 13842 - DNA, 2 bp, Artificial Sequence
  Description of Artificial Sequence: Synthetic oligonucleotide
yg

SEQ ID NO: 13843 - DNA, 2 bp, Artificial Sequence
  Description of Artificial Sequence: Synthetic oligonucleotide
yg

SEQ ID NO: 13844 - DNA, 2 bp, Artificial Sequence
  Description of Artificial Sequence: Synthetic oligonucleotide
yg

SEQ ID NO: 13845 - DNA, 3039 bp, Artificial Sequence
  Description of Artificial Sequence: Synthetic polynucleotide
ygtaygattttgggtgtaagttagagattttataaataygtygggttttgygtagyggttttygggaaggtattgttattygtgggagggttyggttygttattttttattttttgttgttttaaygttattttttaagtttggygtttttttttttttttttggaggttttygtgttgttttggggtgttttttgtgggygagatatataatttgggtgtaagttagggatttygygattatttttggttyggygtaggggtggttatttttgggaygatattatttygttatttttttttttggattgtttttattattttttttaattttggygttttgtattttttttttagtggtttttttgtygttttgtggtgtttttygtgggtgagataygtattyggggtgtaagatagggattttaggaygttttygggtttattgtagaggttgttgggaaggtagtgtygttygtgagaggattttagtattttygtttttttttttyggggttgttttaatttttttttttaagattgaygtgttgtttttttttttygggaatttttttgttgttttgtggtgttygtygtgggtaagatatttattttgggtgtaagttagggaattaataattttygtatgttyggtaaaggggttgtyggtaaggtattgttattygtgggattattttagtttygttgtttttttttttaggttatttaaaygtttttatttaagtttggygttttgttgttttttygygggggattttttgttattttggggtgtttttygtgggygagataygtatattgtgtgtaagatagggatttygygattttttygggattggtataggggttgtagggaaggtattgttattygtgaaaggattttagtttygttttttttttttttgggttgttttaaygtttttttttaagtttggtattttgttttttttttttyggggtttttttgttgttttggggtgttattygtgggygaggtaygtattttgggtgtaaattagggattttaagatttttagggttaggygtaggggatgtygggaagttattgtttttygtggaaagtttttttttggattgttttaaagtttttttttaagtttggtattttgtttttttttttyggagttttttttgtagttttygygtgtatatttaggygagataygtattttgttgtaagatagggattttaaattttttygtttgggttaggtttaggggttgtygggaaggtattgtggtttgtgggaygattatagtttagtygttgtttttttttggttggtttaaygtttttttttaagtttgatatgttgtttttttttttygggggttttgttgttatttttaygtgtatttygtgagtaagataggtattttgggtttaagttaggggttttatygtttatttgggttttatttagaggttgtygggaaggtattgtttttagtggaaatttttttttyggattgttttaaygtttttttttaagttyggygttttgtttttttttattyggggattttttatygtattgyggtgtttatygtgggtaygataygtatttygggtgtaagttagggattttataattattttaggttygatgtaggggttatyggataagatattgttgtttttgggatgatatyggtttgttttaattttattttttaattttggagttttgtattttttttttgggggtttttttgttgttttgtggtgttattygtgggygagatatataatttgggagtaagttagagattttaygatatttttgggtttattgtagaggttgttaggaaggyggtgttattygtgggaggattttagttttattatttttatttyggggtygttttaattttttttttaagtttgaygtgtttttttttttttygggaatttatttgtygttttggggtgtttttttgagygagataygtattttgggtgtaagttayggattttaggattattttggtttagygaaggggttgttaggaaggtattgtygtttgtgggagaaatttagygtygtygtttttttttaygggttattttaaagtttttttttaagtttgaggtgttgttttttttttttaggggtttatttgtygttttggggtgttttttatgggygaaataygtattttgggtgtaagatagggattttaygattttttygggtttagygtagggattgttaggaaggtattgttattygtaggaggaattygattagtygtttttttttttgtgttgttttagtatttttattaaagtttggttttttgtggygttygttyggyggtttttttgttattttggggtgtttttatgggtgygattygtattttyggtgtaagttagggattttaygattatttygggtttgaygtaggggttgttgggaaggtattgtygtttatgggaygattttagtttgttaygttttttttyggattgttttaattattttttttaattttggygttttatatttttttttyggtggtttttttgtygttttgtggtgtttttygagggygagataygtattttgggtgtaagttaaggattttatgaygtttttaggtttattatagatgttgtygggaagatagtgttattygtggtaggattttagtattttttttttattttyggggttgttttaaygtttttttttaagtttgaygtgttgttttttttttttgggaatttatttgtygttttggggtgtttttygtggaattttgggtgtaagtttgggatataataattttttygggtttggtaaaggggttgtygggaaggtatygtggttygtgggaagtttttttttggattgttttaaagtttttttttaagtttggygttttgttttttttttagggggtatttttgtygttttggggtgttttttygtgggygygataygtattttgggtttaagttaggaattttaygataatttygagtttggyg

SEQ ID NO: 13846 - DNA, 2 bp, Artificial Sequence
  Description of Artificial Sequence: Synthetic oligonucleotide
yg

SEQ ID NO: 13847 - DNA, 2 bp, Artificial Sequence
  Description of Artificial Sequence: Synthetic oligonucleotide
yg

SEQ ID NO: 13848 - DNA, 2 bp, Artificial Sequence
  Description of Artificial Sequence: Synthetic oligonucleotide
yg

SEQ ID NO: 13849 - DNA, 2 bp, Artificial Sequence
  Description of Artificial Sequence: Synthetic oligonucleotide
yg

SEQ ID NO: 13850 - DNA, 2 bp, Artificial Sequence
  Description of Artificial Sequence: Synthetic oligonucleotide
yg

SEQ ID NO: 13851 - DNA, 2 bp, Artificial Sequence
  Description of Artificial Sequence: Synthetic oligonucleotide
yg

SEQ ID NO: 13852 - DNA, 2 bp, Artificial Sequence
  Description of Artificial Sequence: Synthetic oligonucleotide
yg

SEQ ID NO: 13853 - DNA, 2 bp, Artificial Sequence
  Description of Artificial Sequence: Synthetic oligonucleotide
yg

SEQ ID NO: 13854 - DNA, 2 bp, Artificial Sequence
  Description of Artificial Sequence: Synthetic oligonucleotide
yg

SEQ ID NO: 13855 - DNA, 2 bp, Artificial Sequence
  Description of Artificial Sequence: Synthetic oligonucleotide
yg

SEQ ID NO: 13856 - DNA, 2 bp, Artificial Sequence
  Description of Artificial Sequence: Synthetic oligonucleotide
tg

SEQ ID NO: 13857 - DNA, 9 bp, Artificial Sequence
  Description of Artificial Sequence: Synthetic oligonucleotide
tgttatttg

SEQ ID NO: 13858 - DNA, 2 bp, Artificial Sequence
  Description of Artificial Sequence: Synthetic oligonucleotide
tg

SEQ ID NO: 13859 - DNA, 2 bp, Artificial Sequence
  Description of Artificial Sequence: Synthetic oligonucleotide
tg

SEQ ID NO: 13860 - DNA, 2 bp, Artificial Sequence
  Description of Artificial Sequence: Synthetic oligonucleotide
tg

SEQ ID NO: 13861 - DNA, 2 bp, Artificial Sequence
  Description of Artificial Sequence: Synthetic oligonucleotide
tg

SEQ ID NO: 13862 - DNA, 2 bp, Artificial Sequence
  Description of Artificial Sequence: Synthetic oligonucleotide
tg

SEQ ID NO: 13863 - DNA, 2 bp, Artificial Sequence
  Description of Artificial Sequence: Synthetic oligonucleotide
tg

SEQ ID NO: 13864 - DNA, 2 bp, Artificial Sequence
  Description of Artificial Sequence: Synthetic oligonucleotide
tg

SEQ ID NO: 13865 - DNA, 2 bp, Artificial Sequence
  Description of Artificial Sequence: Synthetic oligonucleotide
tg

SEQ ID NO: 13866 - DNA, 2 bp, Artificial Sequence
  Description of Artificial Sequence: Synthetic oligonucleotide
tg

SEQ ID NO: 13867 - DNA, 2 bp, Artificial Sequence
  Description of Artificial Sequence: Synthetic oligonucleotide
tg

SEQ ID NO: 13868 - DNA, 36 bp, Artificial Sequence
  Description of Artificial Sequence: Synthetic oligonucleotide
tgtaggttagtgggtgtgtgtattttgtgtgagttg

SEQ ID NO: 13869 - DNA, 2 bp, Artificial Sequence
  Description of Artificial Sequence: Synthetic oligonucleotide
tg

SEQ ID NO: 13870 - DNA, 2 bp, Artificial Sequence
  Description of Artificial Sequence: Synthetic oligonucleotide
tg

SEQ ID NO: 13871 - DNA, 2 bp, Artificial Sequence
  Description of Artificial Sequence: Synthetic oligonucleotide
tg

SEQ ID NO: 13872 - DNA, 2 bp, Artificial Sequence
  Description of Artificial Sequence: Synthetic oligonucleotide
tg

SEQ ID NO: 13873 - DNA, 2 bp, Artificial Sequence
  Description of Artificial Sequence: Synthetic oligonucleotide
tg

SEQ ID NO: 13874 - DNA, 2 bp, Artificial Sequence
  Description of Artificial Sequence: Synthetic oligonucleotide
tg

SEQ ID NO: 13875 - DNA, 2 bp, Artificial Sequence
  Description of Artificial Sequence: Synthetic oligonucleotide
tg

SEQ ID NO: 13876 - DNA, 2 bp, Artificial Sequence
  Description of Artificial Sequence: Synthetic oligonucleotide
tg

SEQ ID NO: 13877 - DNA, 2 bp, Artificial Sequence
  Description of Artificial Sequence: Synthetic oligonucleotide
tg

SEQ ID NO: 13878 - DNA, 2 bp, Artificial Sequence
  Description of Artificial Sequence: Synthetic oligonucleotide
tg

SEQ ID NO: 13879 - DNA, 8 bp, Artificial Sequence
  Description of Artificial Sequence: Synthetic oligonucleotide
tgttgttg

SEQ ID NO: 13880 - DNA, 2 bp, Artificial Sequence
  Description of Artificial Sequence: Synthetic oligonucleotide
tg

SEQ ID NO: 13881 - DNA, 2 bp, Artificial Sequence
  Description of Artificial Sequence: Synthetic oligonucleotide
tg

SEQ ID NO: 13882 - DNA, 2 bp, Artificial Sequence
  Description of Artificial Sequence: Synthetic oligonucleotide
tg

SEQ ID NO: 13883 - DNA, 2 bp, Artificial Sequence
  Description of Artificial Sequence: Synthetic oligonucleotide
tg

SEQ ID NO: 13884 - DNA, 2 bp, Artificial Sequence
  Description of Artificial Sequence: Synthetic oligonucleotide
tg

SEQ ID NO: 13885 - DNA, 2 bp, Artificial Sequence
  Description of Artificial Sequence: Synthetic oligonucleotide
tg

SEQ ID NO: 13886 - DNA, 2 bp, Artificial Sequence
  Description of Artificial Sequence: Synthetic oligonucleotide
tg

SEQ ID NO: 13887 - DNA, 2 bp, Artificial Sequence
  Description of Artificial Sequence: Synthetic oligonucleotide
tg

SEQ ID NO: 13888 - DNA, 2 bp, Artificial Sequence
  Description of Artificial Sequence: Synthetic oligonucleotide
tg

SEQ ID NO: 13889 - DNA, 2 bp, Artificial Sequence
  Description of Artificial Sequence: Synthetic oligonucleotide
tg

SEQ ID NO: 13890 - DNA, 181 bp, Artificial Sequence
  Description of Artificial Sequence: Synthetic polynucleotide
tgatttttttgttttagttttttgagtagttgggattataggtatatgttattatgtttagttaatttttgtttgtttgtttatttatttattattatttttgagatggagttttgttttgttattaggttggagtgttattggagtgtaatggtatgattttggtttattgtaatttttg

SEQ ID NO: 13891 - DNA, 2 bp, Artificial Sequence
  Description of Artificial Sequence: Synthetic oligonucleotide
tg

SEQ ID NO: 13892 - DNA, 2 bp, Artificial Sequence
  Description of Artificial Sequence: Synthetic oligonucleotide
tg

SEQ ID NO: 13893 - DNA, 2 bp, Artificial Sequence
  Description of Artificial Sequence: Synthetic oligonucleotide
tg

SEQ ID NO: 13894 - DNA, 2 bp, Artificial Sequence
  Description of Artificial Sequence: Synthetic oligonucleotide
tg

SEQ ID NO: 13895 - DNA, 2 bp, Artificial Sequence
  Description of Artificial Sequence: Synthetic oligonucleotide
tg

SEQ ID NO: 13896 - DNA, 2 bp, Artificial Sequence
  Description of Artificial Sequence: Synthetic oligonucleotide
tg

SEQ ID NO: 13897 - DNA, 2 bp, Artificial Sequence
  Description of Artificial Sequence: Synthetic oligonucleotide
tg

SEQ ID NO: 13898 - DNA, 2 bp, Artificial Sequence
  Description of Artificial Sequence: Synthetic oligonucleotide
tg

SEQ ID NO: 13899 - DNA, 2 bp, Artificial Sequence
  Description of Artificial Sequence: Synthetic oligonucleotide
tg

SEQ ID NO: 13900 - DNA, 2 bp, Artificial Sequence
  Description of Artificial Sequence: Synthetic oligonucleotide
tg

SEQ ID NO: 13901 - DNA, 369 bp, Artificial Sequence
  Description of Artificial Sequence: Synthetic polynucleotide
tggggaggtttgggttgtataggagtgtatggtgggggtggaggtttaggtatggagggttgtaggttttgagttttgtttggtggggaggtagttaaggtttagtgagaagttgagtatagtagttgttggtttaggtgttaagttttttattgtttgggttggttggttgttttgagtgtggggtttgttaagtttatgtttatttggaatttgagttggtttgtaagtgtagtttgtagttatggtttttgtttatgtttttttttttatatttatttgtaagttgagggagttggttttagttttgtttagtttagaaaggggtttttatagtgtagtgatgggttgaagggttttttaaatgtg

SEQ ID NO: 13902 - DNA, 2 bp, Artificial Sequence
  Description of Artificial Sequence: Synthetic oligonucleotide
tg

SEQ ID NO: 13903 - DNA, 2 bp, Artificial Sequence
  Description of Artificial Sequence: Synthetic oligonucleotide
tg

SEQ ID NO: 13904 - DNA, 2 bp, Artificial Sequence
  Description of Artificial Sequence: Synthetic oligonucleotide
tg

SEQ ID NO: 13905 - DNA, 2 bp, Artificial Sequence
  Description of Artificial Sequence: Synthetic oligonucleotide
tg

SEQ ID NO: 13906 - DNA, 2 bp, Artificial Sequence
  Description of Artificial Sequence: Synthetic oligonucleotide
tg

SEQ ID NO: 13907 - DNA, 2 bp, Artificial Sequence
  Description of Artificial Sequence: Synthetic oligonucleotide
tg

SEQ ID NO: 13908 - DNA, 2 bp, Artificial Sequence
  Description of Artificial Sequence: Synthetic oligonucleotide
tg

SEQ ID NO: 13909 - DNA, 2 bp, Artificial Sequence
  Description of Artificial Sequence: Synthetic oligonucleotide
tg

SEQ ID NO: 13910 - DNA, 2 bp, Artificial Sequence
  Description of Artificial Sequence: Synthetic oligonucleotide
tg

SEQ ID NO: 13911 - DNA, 2 bp, Artificial Sequence
  Description of Artificial Sequence: Synthetic oligonucleotide
tg

SEQ ID NO: 13912 - DNA, 2 bp, Artificial Sequence
  Description of Artificial Sequence: Synthetic oligonucleotide
tg

SEQ ID NO: 13913 - DNA, 2 bp, Artificial Sequence
  Description of Artificial Sequence: Synthetic oligonucleotide
tg

SEQ ID NO: 13914 - DNA, 2 bp, Artificial Sequence
  Description of Artificial Sequence: Synthetic oligonucleotide
tg

SEQ ID NO: 13915 - DNA, 2 bp, Artificial Sequence
  Description of Artificial Sequence: Synthetic oligonucleotide
tg

SEQ ID NO: 13916 - DNA, 2 bp, Artificial Sequence
  Description of Artificial Sequence: Synthetic oligonucleotide
tg

SEQ ID NO: 13917 - DNA, 2 bp, Artificial Sequence
  Description of Artificial Sequence: Synthetic oligonucleotide
tg

SEQ ID NO: 13918 - DNA, 2 bp, Artificial Sequence
  Description of Artificial Sequence: Synthetic oligonucleotide
tg

SEQ ID NO: 13919 - DNA, 2 bp, Artificial Sequence
  Description of Artificial Sequence: Synthetic oligonucleotide
tg

SEQ ID NO: 13920 - DNA, 2 bp, Artificial Sequence
  Description of Artificial Sequence: Synthetic oligonucleotide
tg

SEQ ID NO: 13921 - DNA, 2 bp, Artificial Sequence
  Description of Artificial Sequence: Synthetic oligonucleotide
tg

SEQ ID NO: 13922 - DNA, 2 bp, Artificial Sequence
  Description of Artificial Sequence: Synthetic oligonucleotide
tg

SEQ ID NO: 13923 - DNA, 35 bp, Artificial Sequence
  Description of Artificial Sequence: Synthetic oligonucleotide
tggtagtaaatgaagttgaggtagtggtgtaagtg

SEQ ID NO: 13924 - DNA, 2 bp, Artificial Sequence
  Description of Artificial Sequence: Synthetic oligonucleotide
tg

SEQ ID NO: 13925 - DNA, 2 bp, Artificial Sequence
  Description of Artificial Sequence: Synthetic oligonucleotide
tg

SEQ ID NO: 13926 - DNA, 2 bp, Artificial Sequence
  Description of Artificial Sequence: Synthetic oligonucleotide
tg

SEQ ID NO: 13927 - DNA, 2 bp, Artificial Sequence
  Description of Artificial Sequence: Synthetic oligonucleotide
tg

SEQ ID NO: 13928 - DNA, 2 bp, Artificial Sequence
  Description of Artificial Sequence: Synthetic oligonucleotide
tg

SEQ ID NO: 13929 - DNA, 2 bp, Artificial Sequence
  Description of Artificial Sequence: Synthetic oligonucleotide
tg

SEQ ID NO: 13930 - DNA, 2 bp, Artificial Sequence
  Description of Artificial Sequence: Synthetic oligonucleotide
tg

SEQ ID NO: 13931 - DNA, 2 bp, Artificial Sequence
  Description of Artificial Sequence: Synthetic oligonucleotide
tg

SEQ ID NO: 13932 - DNA, 2 bp, Artificial Sequence
  Description of Artificial Sequence: Synthetic oligonucleotide
tg

SEQ ID NO: 13933 - DNA, 2 bp, Artificial Sequence
  Description of Artificial Sequence: Synthetic oligonucleotide
tg

SEQ ID NO: 13934 - DNA, 487 bp, Artificial Sequence
  Description of Artificial Sequence: Synthetic polynucleotide
tgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgtgagttttgttttgttttgtattaagtttgtattttttaggtttttggtatttttgtttttgggatgtggggtttttatagatttggaaatttttgtttgtttttttttatttagagtaaattgagatgtttataagagtttggaagttgtttttttttgggtttgaagttgtttggaggttggttttgtttttggtttttttgttatagggtaatgtatatattttttattgtatagtttttttgtttaaaattttgttgatttattttgttttttgttttttaaagtttttatttgtgtgttggatttttgttttgggtg

SEQ ID NO: 13935 - DNA, 2 bp, Artificial Sequence
  Description of Artificial Sequence: Synthetic oligonucleotide
tg

SEQ ID NO: 13936 - DNA, 2 bp, Artificial Sequence
  Description of Artificial Sequence: Synthetic oligonucleotide
tg

SEQ ID NO: 13937 - DNA, 2 bp, Artificial Sequence
  Description of Artificial Sequence: Synthetic oligonucleotide
tg

SEQ ID NO: 13938 - DNA, 2 bp, Artificial Sequence
  Description of Artificial Sequence: Synthetic oligonucleotide
tg

SEQ ID NO: 13939 - DNA, 2 bp, Artificial Sequence
  Description of Artificial Sequence: Synthetic oligonucleotide
tg

SEQ ID NO: 13940 - DNA, 2 bp, Artificial Sequence
  Description of Artificial Sequence: Synthetic oligonucleotide
tg

SEQ ID NO: 13941 - DNA, 2 bp, Artificial Sequence
  Description of Artificial Sequence: Synthetic oligonucleotide
tg

SEQ ID NO: 13942 - DNA, 2 bp, Artificial Sequence
  Description of Artificial Sequence: Synthetic oligonucleotide
tg

SEQ ID NO: 13943 - DNA, 2 bp, Artificial Sequence
  Description of Artificial Sequence: Synthetic oligonucleotide
tg

SEQ ID NO: 13944 - DNA, 2 bp, Artificial Sequence
  Description of Artificial Sequence: Synthetic oligonucleotide
tg

SEQ ID NO: 13945 - DNA, 28 bp, Artificial Sequence
  Description of Artificial Sequence: Synthetic oligonucleotide
tggattatgaggttaggagattaagatg

SEQ ID NO: 13946 - DNA, 2 bp, Artificial Sequence
  Description of Artificial Sequence: Synthetic oligonucleotide
tg

SEQ ID NO: 13947 - DNA, 2 bp, Artificial Sequence
  Description of Artificial Sequence: Synthetic oligonucleotide
tg

SEQ ID NO: 13948 - DNA, 2 bp, Artificial Sequence
  Description of Artificial Sequence: Synthetic oligonucleotide
tg

SEQ ID NO: 13949 - DNA, 2 bp, Artificial Sequence
  Description of Artificial Sequence: Synthetic oligonucleotide
tg

SEQ ID NO: 13950 - DNA, 2 bp, Artificial Sequence
  Description of Artificial Sequence: Synthetic oligonucleotide
tg

SEQ ID NO: 13951 - DNA, 2 bp, Artificial Sequence
  Description of Artificial Sequence: Synthetic oligonucleotide
tg

SEQ ID NO: 13952 - DNA, 2 bp, Artificial Sequence
  Description of Artificial Sequence: Synthetic oligonucleotide
tg

SEQ ID NO: 13953 - DNA, 2 bp, Artificial Sequence
  Description of Artificial Sequence: Synthetic oligonucleotide
tg

SEQ ID NO: 13954 - DNA, 2 bp, Artificial Sequence
  Description of Artificial Sequence: Synthetic oligonucleotide
tg

SEQ ID NO: 13955 - DNA, 2 bp, Artificial Sequence
  Description of Artificial Sequence: Synthetic oligonucleotide
tg

SEQ ID NO: 13956 - DNA, 2 bp, Artificial Sequence
  Description of Artificial Sequence: Synthetic oligonucleotide
tg

SEQ ID NO: 13957 - DNA, 2 bp, Artificial Sequence
  Description of Artificial Sequence: Synthetic oligonucleotide
tg

SEQ ID NO: 13958 - DNA, 2 bp, Artificial Sequence
  Description of Artificial Sequence: Synthetic oligonucleotide
tg

SEQ ID NO: 13959 - DNA, 2 bp, Artificial Sequence
  Description of Artificial Sequence: Synthetic oligonucleotide
tg

SEQ ID NO: 13960 - DNA, 2 bp, Artificial Sequence
  Description of Artificial Sequence: Synthetic oligonucleotide
tg

SEQ ID NO: 13961 - DNA, 2 bp, Artificial Sequence
  Description of Artificial Sequence: Synthetic oligonucleotide
tg

SEQ ID NO: 13962 - DNA, 2 bp, Artificial Sequence
  Description of Artificial Sequence: Synthetic oligonucleotide
tg

SEQ ID NO: 13963 - DNA, 2 bp, Artificial Sequence
  Description of Artificial Sequence: Synthetic oligonucleotide
tg

SEQ ID NO: 13964 - DNA, 2 bp, Artificial Sequence
  Description of Artificial Sequence: Synthetic oligonucleotide
tg

SEQ ID NO: 13965 - DNA, 2 bp, Artificial Sequence
  Description of Artificial Sequence: Synthetic oligonucleotide
tg

SEQ ID NO: 13966 - DNA, 2 bp, Artificial Sequence
  Description of Artificial Sequence: Synthetic oligonucleotide
tg

SEQ ID NO: 13967 - DNA, 18 bp, Artificial Sequence
  Description of Artificial Sequence: Synthetic oligonucleotide
tgtggttaggaaggtgtg

SEQ ID NO: 13968 - DNA, 18 bp, Artificial Sequence
  Description of Artificial Sequence: Synthetic oligonucleotide
tgtatttattgatttgtg

SEQ ID NO: 13969 - DNA, 2 bp, Artificial Sequence
  Description of Artificial Sequence: Synthetic oligonucleotide
tg

SEQ ID NO: 13970 - DNA, 2 bp, Artificial Sequence
  Description of Artificial Sequence: Synthetic oligonucleotide
tg

SEQ ID NO: 13971 - DNA, 2 bp, Artificial Sequence
  Description of Artificial Sequence: Synthetic oligonucleotide
tg

SEQ ID NO: 13972 - DNA, 2 bp, Artificial Sequence
  Description of Artificial Sequence: Synthetic oligonucleotide
tg

SEQ ID NO: 13973 - DNA, 2 bp, Artificial Sequence
  Description of Artificial Sequence: Synthetic oligonucleotide
tg

SEQ ID NO: 13974 - DNA, 2 bp, Artificial Sequence
  Description of Artificial Sequence: Synthetic oligonucleotide
tg

SEQ ID NO: 13975 - DNA, 2 bp, Artificial Sequence
  Description of Artificial Sequence: Synthetic oligonucleotide
tg

SEQ ID NO: 13976 - DNA, 2 bp, Artificial Sequence
  Description of Artificial Sequence: Synthetic oligonucleotide
tg

SEQ ID NO: 13977 - DNA, 2 bp, Artificial Sequence
  Description of Artificial Sequence: Synthetic oligonucleotide
tg

SEQ ID NO: 13978 - DNA, 2 bp, Artificial Sequence
  Description of Artificial Sequence: Synthetic oligonucleotide
tg

SEQ ID NO: 13979 - DNA, 87 bp, Artificial Sequence
  Description of Artificial Sequence: Synthetic oligonucleotide
tgttatttatttatttgatttggaaagggaattttttgattttttgtgttttttaggtgaggtaatgttttgttttgttttggtttg

SEQ ID NO: 13980 - DNA, 2 bp, Artificial Sequence
  Description of Artificial Sequence: Synthetic oligonucleotide
tg

SEQ ID NO: 13981 - DNA, 2 bp, Artificial Sequence
  Description of Artificial Sequence: Synthetic oligonucleotide
tg

SEQ ID NO: 13982 - DNA, 2 bp, Artificial Sequence
  Description of Artificial Sequence: Synthetic oligonucleotide
tg

SEQ ID NO: 13983 - DNA, 2 bp, Artificial Sequence
  Description of Artificial Sequence: Synthetic oligonucleotide
tg

SEQ ID NO: 13984 - DNA, 2 bp, Artificial Sequence
  Description of Artificial Sequence: Synthetic oligonucleotide
tg

SEQ ID NO: 13985 - DNA, 2 bp, Artificial Sequence
  Description of Artificial Sequence: Synthetic oligonucleotide
tg

SEQ ID NO: 13986 - DNA, 2 bp, Artificial Sequence
  Description of Artificial Sequence: Synthetic oligonucleotide
tg

SEQ ID NO: 13987 - DNA, 2 bp, Artificial Sequence
  Description of Artificial Sequence: Synthetic oligonucleotide
tg

SEQ ID NO: 13988 - DNA, 2 bp, Artificial Sequence
  Description of Artificial Sequence: Synthetic oligonucleotide
tg

SEQ ID NO: 13989 - DNA, 2 bp, Artificial Sequence
  Description of Artificial Sequence: Synthetic oligonucleotide
tg

SEQ ID NO: 13990 - DNA, 11 bp, Artificial Sequence
  Description of Artificial Sequence: Synthetic oligonucleotide
tgtaagttttg

SEQ ID NO: 13991 - DNA, 2 bp, Artificial Sequence
  Description of Artificial Sequence: Synthetic oligonucleotide
tg

SEQ ID NO: 13992 - DNA, 2 bp, Artificial Sequence
  Description of Artificial Sequence: Synthetic oligonucleotide
tg

SEQ ID NO: 13993 - DNA, 2 bp, Artificial Sequence
  Description of Artificial Sequence: Synthetic oligonucleotide
tg

SEQ ID NO: 13994 - DNA, 2 bp, Artificial Sequence
  Description of Artificial Sequence: Synthetic oligonucleotide
tg

SEQ ID NO: 13995 - DNA, 2 bp, Artificial Sequence
  Description of Artificial Sequence: Synthetic oligonucleotide
tg

SEQ ID NO: 13996 - DNA, 2 bp, Artificial Sequence
  Description of Artificial Sequence: Synthetic oligonucleotide
tg

SEQ ID NO: 13997 - DNA, 2 bp, Artificial Sequence
  Description of Artificial Sequence: Synthetic oligonucleotide
tg

SEQ ID NO: 13998 - DNA, 2 bp, Artificial Sequence
  Description of Artificial Sequence: Synthetic oligonucleotide
tg

SEQ ID NO: 13999 - DNA, 2 bp, Artificial Sequence
  Description of Artificial Sequence: Synthetic oligonucleotide
tg

SEQ ID NO: 14000 - DNA, 2 bp, Artificial Sequence
  Description of Artificial Sequence: Synthetic oligonucleotide
tg

SEQ ID NO: 14001 - DNA, 2 bp, Artificial Sequence
  Description of Artificial Sequence: Synthetic oligonucleotide
tg

SEQ ID NO: 14002 - DNA, 2 bp, Artificial Sequence
  Description of Artificial Sequence: Synthetic oligonucleotide
tg

SEQ ID NO: 14003 - DNA, 2 bp, Artificial Sequence
  Description of Artificial Sequence: Synthetic oligonucleotide
tg

SEQ ID NO: 14004 - DNA, 2 bp, Artificial Sequence
  Description of Artificial Sequence: Synthetic oligonucleotide
tg

SEQ ID NO: 14005 - DNA, 2 bp, Artificial Sequence
  Description of Artificial Sequence: Synthetic oligonucleotide
tg

SEQ ID NO: 14006 - DNA, 2 bp, Artificial Sequence
  Description of Artificial Sequence: Synthetic oligonucleotide
tg

SEQ ID NO: 14007 - DNA, 2 bp, Artificial Sequence
  Description of Artificial Sequence: Synthetic oligonucleotide
tg

SEQ ID NO: 14008 - DNA, 2 bp, Artificial Sequence
  Description of Artificial Sequence: Synthetic oligonucleotide
tg

SEQ ID NO: 14009 - DNA, 2 bp, Artificial Sequence
  Description of Artificial Sequence: Synthetic oligonucleotide
tg

SEQ ID NO: 14010 - DNA, 167 bp, Artificial Sequence
  Description of Artificial Sequence: Synthetic polynucleotide
tgttattttttaagttggtttgaaaagtgtaatatttgggtgggagtgatttgattttttaggtgtgttggttatttttttttttgatttggaaagggaattttttgatttttggtgttttttaggtgaggtaatgttttgttttgttttggtttgtttatggtgtg

SEQ ID NO: 14011 - DNA, 2 bp, Artificial Sequence
  Description of Artificial Sequence: Synthetic oligonucleotide
tg

SEQ ID NO: 14012 - DNA, 2 bp, Artificial Sequence
  Description of Artificial Sequence: Synthetic oligonucleotide
tg

SEQ ID NO: 14013 - DNA, 2 bp, Artificial Sequence
  Description of Artificial Sequence: Synthetic oligonucleotide
tg

SEQ ID NO: 14014 - DNA, 185 bp, Artificial Sequence
  Description of Artificial Sequence: Synthetic polynucleotide
tggtgtttatatatgttgtttttaaaaaaatttgttttgtttaggtttgtgtgaatataatgttggatgaattttgtttttttagaagaaagttgggttggtgtgtttgatgatgtagtgtttgtagtggtgtttgataaagtgtagggtttttatggagattttgtagttttggatatttagtg

SEQ ID NO: 14015 - DNA, 17 bp, Artificial Sequence
  Description of Artificial Sequence: Synthetic oligonucleotide
tgttttgttttggtttg

SEQ ID NO: 14016 - DNA, 135 bp, Artificial Sequence
  Description of Artificial Sequence: Synthetic polynucleotide
tgtaatatttgggtgggagtgatttgattttttaggtgtgtttgttatttttttttttgattaggaaagggaattttttgatttttggtgttttttgagtgaggtattgttttattttgttttggtttgtgtatg

SEQ ID NO: 14017 - DNA, 2 bp, Artificial Sequence
  Description of Artificial Sequence: Synthetic oligonucleotide
tg

SEQ ID NO: 14018 - DNA, 71 bp, Artificial Sequence
  Description of Artificial Sequence: Synthetic oligonucleotide
tggtgggttgaagggttttttaagtgtggttagagtgggtgttaaggttgaggaggtgttaagagtgagtg

SEQ ID NO: 14019 - DNA, 54 bp, Artificial Sequence
  Description of Artificial Sequence: Synthetic oligonucleotide
tgttttttaagtgaggtaatgttttgttttgttttggtttgtgtatggtgtgtg

SEQ ID NO: 14020 - DNA, 5 bp, Artificial Sequence
  Description of Artificial Sequence: Synthetic oligonucleotide
tgttg

SEQ ID NO: 14021 - DNA, 29 bp, Artificial Sequence
  Description of Artificial Sequence: Synthetic oligonucleotide
tgttttttttatgggtttaaaaattggtg

SEQ ID NO: 14022 - DNA, 18 bp, Artificial Sequence
  Description of Artificial Sequence: Synthetic oligonucleotide
tgtagatattagaaagtg

SEQ ID NO: 14023 - DNA, 2 bp, Artificial Sequence
  Description of Artificial Sequence: Synthetic oligonucleotide
tg

SEQ ID NO: 14024 - DNA, 5 bp, Artificial Sequence
  Description of Artificial Sequence: Synthetic oligonucleotide
tgttg

SEQ ID NO: 14025 - DNA, 24 bp, Artificial Sequence
  Description of Artificial Sequence: Synthetic oligonucleotide
tgagtttgtgtaggaggtgttttg

SEQ ID NO: 14026 - DNA, 2 bp, Artificial Sequence
  Description of Artificial Sequence: Synthetic oligonucleotide
tg

SEQ ID NO: 14027 - DNA, 4 bp, Artificial Sequence
  Description of Artificial Sequence: Synthetic oligonucleotide
tgtg

SEQ ID NO: 14028 - DNA, 2 bp, Artificial Sequence
  Description of Artificial Sequence: Synthetic oligonucleotide
tg

SEQ ID NO: 14029 - DNA, 2 bp, Artificial Sequence
  Description of Artificial Sequence: Synthetic oligonucleotide
tg

SEQ ID NO: 14030 - DNA, 2 bp, Artificial Sequence
  Description of Artificial Sequence: Synthetic oligonucleotide
tg

SEQ ID NO: 14031 - DNA, 2 bp, Artificial Sequence
  Description of Artificial Sequence: Synthetic oligonucleotide
tg

SEQ ID NO: 14032 - DNA, 2 bp, Artificial Sequence
  Description of Artificial Sequence: Synthetic oligonucleotide
tg

SEQ ID NO: 14033 - DNA, 2 bp, Artificial Sequence
  Description of Artificial Sequence: Synthetic oligonucleotide
tg

SEQ ID NO: 14034 - DNA, 2 bp, Artificial Sequence
  Description of Artificial Sequence: Synthetic oligonucleotide
tg

SEQ ID NO: 14035 - DNA, 2 bp, Artificial Sequence
  Description of Artificial Sequence: Synthetic oligonucleotide
tg

SEQ ID NO: 14036 - DNA, 2 bp, Artificial Sequence
  Description of Artificial Sequence: Synthetic oligonucleotide
tg

SEQ ID NO: 14037 - DNA, 2 bp, Artificial Sequence
  Description of Artificial Sequence: Synthetic oligonucleotide
tg

SEQ ID NO: 14038 - DNA, 12 bp, Artificial Sequence
  Description of Artificial Sequence: Synthetic oligonucleotide
tgatttgttttg

SEQ ID NO: 14039 - DNA, 2 bp, Artificial Sequence
  Description of Artificial Sequence: Synthetic oligonucleotide
tg

SEQ ID NO: 14040 - DNA, 2 bp, Artificial Sequence
  Description of Artificial Sequence: Synthetic oligonucleotide
tg

SEQ ID NO: 14041 - DNA, 2 bp, Artificial Sequence
  Description of Artificial Sequence: Synthetic oligonucleotide
tg

SEQ ID NO: 14042 - DNA, 2 bp, Artificial Sequence
  Description of Artificial Sequence: Synthetic oligonucleotide
tg

SEQ ID NO: 14043 - DNA, 2 bp, Artificial Sequence
  Description of Artificial Sequence: Synthetic oligonucleotide
tg

SEQ ID NO: 14044 - DNA, 2 bp, Artificial Sequence
  Description of Artificial Sequence: Synthetic oligonucleotide
tg

SEQ ID NO: 14045 - DNA, 2 bp, Artificial Sequence
  Description of Artificial Sequence: Synthetic oligonucleotide
tg

SEQ ID NO: 14046 - DNA, 2 bp, Artificial Sequence
  Description of Artificial Sequence: Synthetic oligonucleotide
tg

SEQ ID NO: 14047 - DNA, 2 bp, Artificial Sequence
  Description of Artificial Sequence: Synthetic oligonucleotide
tg

SEQ ID NO: 14048 - DNA, 2 bp, Artificial Sequence
  Description of Artificial Sequence: Synthetic oligonucleotide
tg

SEQ ID NO: 14049 - DNA, 2 bp, Artificial Sequence
  Description of Artificial Sequence: Synthetic oligonucleotide
tg

SEQ ID NO: 14050 - DNA, 2 bp, Artificial Sequence
  Description of Artificial Sequence: Synthetic oligonucleotide
tg

SEQ ID NO: 14051 - DNA, 2 bp, Artificial Sequence
  Description of Artificial Sequence: Synthetic oligonucleotide
tg

SEQ ID NO: 14052 - DNA, 2 bp, Artificial Sequence
  Description of Artificial Sequence: Synthetic oligonucleotide
tg

SEQ ID NO: 14053 - DNA, 2 bp, Artificial Sequence
  Description of Artificial Sequence: Synthetic oligonucleotide
tg

SEQ ID NO: 14054 - DNA, 2 bp, Artificial Sequence
  Description of Artificial Sequence: Synthetic oligonucleotide
tg

SEQ ID NO: 14055 - DNA, 2 bp, Artificial Sequence
  Description of Artificial Sequence: Synthetic oligonucleotide
tg

SEQ ID NO: 14056 - DNA, 2 bp, Artificial Sequence
  Description of Artificial Sequence: Synthetic oligonucleotide
tg

SEQ ID NO: 14057 - DNA, 2 bp, Artificial Sequence
  Description of Artificial Sequence: Synthetic oligonucleotide
tg

SEQ ID NO: 14058 - DNA, 2 bp, Artificial Sequence
  Description of Artificial Sequence: Synthetic oligonucleotide
tg

SEQ ID NO: 14059 - DNA, 2 bp, Artificial Sequence
  Description of Artificial Sequence: Synthetic oligonucleotide
tg

SEQ ID NO: 14060 - DNA, 80 bp, Artificial Sequence
  Description of Artificial Sequence: Synthetic oligonucleotide
tgtagtggaaggtttggagtagaggttgtttttttgtttaagtattttttgggtgagtttatatttttggtgtgagtatg

SEQ ID NO: 14061 - DNA, 2 bp, Artificial Sequence
  Description of Artificial Sequence: Synthetic oligonucleotide
tg

SEQ ID NO: 14062 - DNA, 2 bp, Artificial Sequence
  Description of Artificial Sequence: Synthetic oligonucleotide
tg

SEQ ID NO: 14063 - DNA, 2 bp, Artificial Sequence
  Description of Artificial Sequence: Synthetic oligonucleotide
tg

SEQ ID NO: 14064 - DNA, 2 bp, Artificial Sequence
  Description of Artificial Sequence: Synthetic oligonucleotide
tg

SEQ ID NO: 14065 - DNA, 2 bp, Artificial Sequence
  Description of Artificial Sequence: Synthetic oligonucleotide
tg

SEQ ID NO: 14066 - DNA, 2 bp, Artificial Sequence
  Description of Artificial Sequence: Synthetic oligonucleotide
tg

SEQ ID NO: 14067 - DNA, 2 bp, Artificial Sequence
  Description of Artificial Sequence: Synthetic oligonucleotide
tg

SEQ ID NO: 14068 - DNA, 2 bp, Artificial Sequence
  Description of Artificial Sequence: Synthetic oligonucleotide
tg

SEQ ID NO: 14069 - DNA, 2 bp, Artificial Sequence
  Description of Artificial Sequence: Synthetic oligonucleotide
tg

SEQ ID NO: 14070 - DNA, 2 bp, Artificial Sequence
  Description of Artificial Sequence: Synthetic oligonucleotide
tg

SEQ ID NO: 14071 - DNA, 4 bp, Artificial Sequence
  Description of Artificial Sequence: Synthetic oligonucleotide
tgtg

SEQ ID NO: 14072 - DNA, 2 bp, Artificial Sequence
  Description of Artificial Sequence: Synthetic oligonucleotide
tg

SEQ ID NO: 14073 - DNA, 2 bp, Artificial Sequence
  Description of Artificial Sequence: Synthetic oligonucleotide
tg

SEQ ID NO: 14074 - DNA, 2 bp, Artificial Sequence
  Description of Artificial Sequence: Synthetic oligonucleotide
tg

SEQ ID NO: 14075 - DNA, 2 bp, Artificial Sequence
  Description of Artificial Sequence: Synthetic oligonucleotide
tg

SEQ ID NO: 14076 - DNA, 2 bp, Artificial Sequence
  Description of Artificial Sequence: Synthetic oligonucleotide
tg

SEQ ID NO: 14077 - DNA, 2 bp, Artificial Sequence
  Description of Artificial Sequence: Synthetic oligonucleotide
tg

SEQ ID NO: 14078 - DNA, 2 bp, Artificial Sequence
  Description of Artificial Sequence: Synthetic oligonucleotide
tg

SEQ ID NO: 14079 - DNA, 2 bp, Artificial Sequence
  Description of Artificial Sequence: Synthetic oligonucleotide
tg

SEQ ID NO: 14080 - DNA, 2 bp, Artificial Sequence
  Description of Artificial Sequence: Synthetic oligonucleotide
tg

SEQ ID NO: 14081 - DNA, 2 bp, Artificial Sequence
  Description of Artificial Sequence: Synthetic oligonucleotide
tg

SEQ ID NO: 14082 - DNA, 3039 bp, Artificial Sequence
  Description of Artificial Sequence: Synthetic polynucleotide
tgtatgattttgggtgtaagttagagattttataaatatgttgggttttgtgtagtggtttttgggaaggtattgttatttgtgggagggtttggtttgttattttttattttttgttgttttaatgttattttttaagtttggtgtttttttttttttttttggaggtttttgtgttgttttggggtgttttttgtgggtgagatatataatttgggtgtaagttagggattttgtgattatttttggtttggtgtaggggtggttatttttgggatgatattattttgttatttttttttttggattgtttttattattttttttaattttggtgttttgtattttttttttagtggtttttttgttgttttgtggtgttttttgtgggtgagatatgtatttggggtgtaagatagggattttaggatgtttttgggtttattgtagaggttgttgggaaggtagtgttgtttgtgagaggattttagtatttttgttttttttttttggggttgttttaatttttttttttaagattgatgtgttgttttttttttttgggaatttttttgttgttttgtggtgtttgttgtgggtaagatatttattttgggtgtaagttagggaattaataatttttgtatgtttggtaaaggggttgttggtaaggtattgttatttgtgggattattttagttttgttgtttttttttttaggttatttaaatgtttttatttaagtttggtgttttgttgtttttttgtgggggattttttgttattttggggtgttttttgtgggtgagatatgtatattgtgtgtaagatagggattttgtgatttttttgggattggtataggggttgtagggaaggtattgttatttgtgaaaggattttagttttgttttttttttttttgggttgttttaatgtttttttttaagtttggtattttgtttttttttttttggggtttttttgttgttttggggtgttatttgtgggtgaggtatgtattttgggtgtaaattagggattttaagatttttagggttaggtgtaggggatgttgggaagttattgttttttgtggaaagtttttttttggattgttttaaagtttttttttaagtttggtattttgttttttttttttggagttttttttgtagtttttgtgtgtatatttaggtgagatatgtattttgttgtaagatagggattttaaatttttttgtttgggttaggtttaggggttgttgggaaggtattgtggtttgtgggatgattatagtttagttgttgtttttttttggttggtttaatgtttttttttaagtttgatatgttgttttttttttttgggggttttgttgttatttttatgtgtattttgtgagtaagataggtattttgggtttaagttaggggttttattgtttatttgggttttatttagaggttgttgggaaggtattgtttttagtggaaattttttttttggattgttttaatgtttttttttaagtttggtgttttgtttttttttatttggggattttttattgtattgtggtgtttattgtgggtatgatatgtattttgggtgtaagttagggattttataattattttaggtttgatgtaggggttattggataagatattgttgtttttgggatgatattggtttgttttaattttattttttaattttggagttttgtattttttttttgggggtttttttgttgttttgtggtgttatttgtgggtgagatatataatttgggagtaagttagagattttatgatatttttgggtttattgtagaggttgttaggaaggtggtgttatttgtgggaggattttagttttattatttttattttggggttgttttaattttttttttaagtttgatgtgttttttttttttttgggaatttatttgttgttttggggtgtttttttgagtgagatatgtattttgggtgtaagttatggattttaggattattttggtttagtgaaggggttgttaggaaggtattgttgtttgtgggagaaatttagtgttgttgtttttttttatgggttattttaaagtttttttttaagtttgaggtgttgttttttttttttaggggtttatttgttgttttggggtgttttttatgggtgaaatatgtattttgggtgtaagatagggattttatgatttttttgggtttagtgtagggattgttaggaaggtattgttatttgtaggaggaatttgattagttgtttttttttttgtgttgttttagtatttttattaaagtttggttttttgtggtgtttgtttggtggtttttttgttattttggggtgtttttatgggtgtgatttgtatttttggtgtaagttagggattttatgattattttgggtttgatgtaggggttgttgggaaggtattgttgtttatgggatgattttagtttgttatgtttttttttggattgttttaattattttttttaattttggtgttttatattttttttttggtggtttttttgttgttttgtggtgttttttgagggtgagatatgtattttgggtgtaagttaaggattttatgatgtttttaggtttattatagatgttgttgggaagatagtgttatttgtggtaggattttagtattttttttttatttttggggttgttttaatgtttttttttaagtttgatgtgttgttttttttttttgggaatttatttgttgttttggggtgttttttgtggaattttgggtgtaagtttgggatataataatttttttgggtttggtaaaggggttgttgggaaggtattgtggtttgtgggaagtttttttttggattgttttaaagtttttttttaagtttggtgttttgttttttttttagggggtatttttgttgttttggggtgtttttttgtgggtgtgatatgtattttgggtttaagttaggaattttatgataattttgagtttggtg

SEQ ID NO: 14083 - DNA, 2 bp, Artificial Sequence
  Description of Artificial Sequence: Synthetic oligonucleotide
tg

SEQ ID NO: 14084 - DNA, 2 bp, Artificial Sequence
  Description of Artificial Sequence: Synthetic oligonucleotide
tg

SEQ ID NO: 14085 - DNA, 2 bp, Artificial Sequence
  Description of Artificial Sequence: Synthetic oligonucleotide
tg

SEQ ID NO: 14086 - DNA, 2 bp, Artificial Sequence
  Description of Artificial Sequence: Synthetic oligonucleotide
tg

SEQ ID NO: 14087 - DNA, 2 bp, Artificial Sequence
  Description of Artificial Sequence: Synthetic oligonucleotide
tg

SEQ ID NO: 14088 - DNA, 2 bp, Artificial Sequence
  Description of Artificial Sequence: Synthetic oligonucleotide
tg

SEQ ID NO: 14089 - DNA, 2 bp, Artificial Sequence
  Description of Artificial Sequence: Synthetic oligonucleotide
tg

SEQ ID NO: 14090 - DNA, 2 bp, Artificial Sequence
  Description of Artificial Sequence: Synthetic oligonucleotide
tg

SEQ ID NO: 14091 - DNA, 2 bp, Artificial Sequence
  Description of Artificial Sequence: Synthetic oligonucleotide
tg

SEQ ID NO: 14092 - DNA, 2 bp, Artificial Sequence
  Description of Artificial Sequence: Synthetic oligonucleotide
tg

SEQ ID NO: 14093 - DNA, 201 bp, Homo sapiens
gagtgcagtggcgtgatctcggctcactgcaagctccgcctcccgggatcacgccattctcctgcctcagcctcccgagtggctgggacttacaggtgcccgccaacatgcccggctaattttctgtatttttagtagagacggggtttcaccgtgttagccaggatggtctcgatatcctgacctcgtgacccgcccacc

SEQ ID NO: 14094 - DNA, 208 bp, Homo sapiens
ctggctaacatgatgaaaccctgtctctactaaaaatataaaaaattagccgggcgtggtggcgggcgcctgtagtcccagctactcgggagactgaggccgaatggcgtgaacccgggaggcggagcttgcagtgagccgagatcacaccactgcactccagcctgggcgacagagcgagactctgtctcaaaaataaataaataaa

SEQ ID NO: 14095 - DNA, 201 bp, Homo sapiens
acacggtgaaaccccgtctctactaaagtacaaaaaattagccgggcatagtggcacaggcctttagccccagctacttgggaggctgaggtaggagaatcgcttgaacccgggaggcggagggtgcagtgagccactgcacgccagcctgggcaacagagccagactccgtctcaaaaaaaaaaaaaaaaaagaaagaaa

SEQ ID NO: 14096 - DNA, 201 bp, Homo sapiens
gccgaggtgggcgaatcacctgaggtcaggagttcaagaccagcctggtcaacatggtgaaaccccatctctactaaaaatacaaaaattaaccgggcatcgtggtgcgtgcctgtaatcccagctactcgggagactgaggcaggagaattgcttgaaccctgccggcagaggttgcaatgagctgagattgcaccacgg

SEQ ID NO: 14097 - DNA, 201 bp, Homo sapiens
ttctggaggtcatatttggacaggagccggttcttaacctcagccaagagtccacagaggggcctttgtttaactgcatggagctcatggctgacaggcgcggcggcaggacgggacgggaccggacgggctgtgtacctgtctttataccagtaccatactgttctgattactctagcttgtaagatgtttgaaacccac

SEQ ID NO: 14098 - DNA, 201 bp, Homo sapiens
aaaaccacaacaaagcctctgttcaaccacagattctgacccattggccaggcaggctgtttggcctctgatttgcacctagagggtccccggatcctggcgctgcgtgggtcagtgtctcgggagccggggaccggcactggccgtgctcggttgctgagtgtgcctcactaactatcattccgttcttccaggtcaatg

SEQ ID NO: 14099 - DNA, 201 bp, Homo sapiens
gaggccctctccatccaggtaaagaagaaagaaggatggctccaggagttcacataacatggccaaaggccgggcagcgtgcagcagaatgcaagatgagcggccaggttatagggcgagatcatgaaggattcttccccggccccaaatgttctttaagagtgtcctctcaccatccctcctctcatcccccaagaatag

SEQ ID NO: 14100 - DNA, 201 bp, Homo sapiens
ctcccaagtagctgggactacaggcgcccgccaccacgcccggctaatttttaatatttttagtagagacggggtttcactgtgttagccaggatggtctcgatctcctgacctcgtgatccgcccgcctcggcctcccaaagtgctgggattacaggcttgagccactgcgcccggccttcagttttcatatctgttaaa

SEQ ID NO: 14101 - DNA, 201 bp, Homo sapiens
ttaacacaaaaattagttgttttagccgggcgcggtggctcaagcctgtaatcccagcactttgggaggccgaggcgggcggatcacgaggtcaggagatcgagaccatcctggctaacacggtgaaaccccgtctctactaaaaacacacaaaaaatgagccgggcgcggtggcaggcgcctgtagtcccagctattcag

SEQ ID NO: 14102 - DNA, 201 bp, Homo sapiens
taaatcttgctgctgttcactctatgggtccacactgcctttatgagctgtaacactcaccgcaaaggtctgcaggttcactcctgagccggcaagaccacgaacccaccagaagaaactccgaacacatccgaacatcagaaggaacaaactccggacacgccacctttaagaactgtaacactcaccgcaagggtccgt

SEQ ID NO: 14103 - DNA, 201 bp, Homo sapiens
tcctgcctcagccttcccagtagctgggactacaggcgcccgccaccgcgcccggctaattttttgtatttttaatagaaacggggtttcaccgtggtctcgatctcctgacctcgtgatccgccgcccacctcggcctcccaaagtgctgggattacaggcgtgagccaccgcgcccggcctccttctttatttttaata

SEQ ID NO: 14104 - DNA, 201 bp, Homo sapiens
ggggtttcaccgtgttagccaggatggtctcgatctcctgaccttgtaatacgcccgcctcggccccccaaaatgctgggattacaggcgtgagccaccgcgcccagccggtttcacaggtatttatgtatatcaatagtttttttttgagacggagtctcgctctattcccaggctggagtgcaatggcgctgtcttgac

SEQ ID NO: 14105 - DNA, 235 bp, Homo sapiens
ccaattttccaggtgccgtctgtcacccctttctttgactaggaaagggaactccctgaccccttgtgcttccggagtgaggcaatgcctcgccctgcttcggctcacgcagggtgcgcgcacccactgacctgcgcccactgtctggcactccctagtgagatgaacccggtacctcagatggaaatgcagaaatcacccatcttctgcgtcgctctctctgggagctgtagac

SEQ ID NO: 14106 - DNA, 201 bp, Homo sapiens
ggtagataaagatacatgattagggccggccgcggtgactcatgcctgtaatcccagcactttgggaggccaaggcgaacggatcacgaagtcaggagatcgagaccatcctggctaacatggtgaaaccctgtctctactaaaaatacaaaaaattagccgagcgtggtggtgggcgcctgtagcgccagctactcgggg

SEQ ID NO: 14107 - DNA, 201 bp, Homo sapiens
caggtgatttctgcatttccatctgaggtaccgggttcatctcactagggagtgccagacagtgggcgcgggtcagtgggtgcgtgcaccatgcgcaagccgaagcagggcgaggcattgcctcacttgggaagcgcaaggggacagggagttccctttccgagtcaaaaaaaggggtgacagacgcacctggataatcag

SEQ ID NO: 14108 - DNA, 201 bp, Homo sapiens
agagacagaagctgctggagggcgagaggaacgcatcagtggaagaagacagaagcggctggtcacggagagcatgtcagcagaagaacacacctacagacgccggctcgcccgcgggctccccggcaggccatcgaccggtgggacgaggtggagtttgtcctgggcagtaggaggacagcccgggcacccagcggccca

SEQ ID NO: 14109 - DNA, 201 bp, Homo sapiens
cctacagaggcaggcaggcctccttgagctgtggtgggctccacccagttcgagcttcccggctgctttgtttacctaagcgagcctgggcaatggcgggcgcccctcccccagcctcgctgctgccttgcagtttgatctcagactgctgtgctagcaatcagcaagactcggtgggcataggaccctccgagccaggtg

SEQ ID NO: 14110 - DNA, 201 bp, Homo sapiens
gttccctttcctagtcaaagaaaggggtgacagaaggcacctggaaaatcgggtcactcccaccagaatactgcgcttttccgacgggcttaaaaaacggcgcacctggagattatatccggcacctggctcagagggtcctacgcccacagagtctcgctgattgctagcacagcagtctaagatcaaactgcaaggcgg

SEQ ID NO: 14111 - DNA, 201 bp, Homo sapiens
cgtccgtcacccctttctttgactcggaaagggaactccctgaccccttgtgcttcccaggtgaggcaatgcctcgccctgcttcggctcgcgcacggtgcgcgcacccactggcctgcgcccactgtctggcactcccttagtgagatgaacccggtacctcagatggaaatgcagaaatcacccgtcttctgcgtcgct

SEQ ID NO: 14112 - DNA, 201 bp, Homo sapiens
gcaagcaaggggcgtgtttcagctctgtttgtgttagagctctttcacctccaccatttggcaggttcagcgcccgggaacaatgacgtacgtggacaagcggagggtgagcaaggtgaagaggagctttactgagtaatagaacagctcagaggagactcgcggtgggtagctcctctctgcagccagggtgtcctgatg

SEQ ID NO: 14113 - DNA, 201 bp, Homo sapiens
ggcagatcacctgaggtcaggagttcgagaccagcctggccaacatggtgaaaccccgtctctactaaaaatacaaatatcagccgggcgtggtggtggtcgcctgtaatctcagctactcgggaggctgaggcaggagaattgctggatcccgggaggcagatgttgcagtgagccaagatcatgccattgcactccagc

SEQ ID NO: 14114 - DNA, 201 bp, Homo sapiens
ctgtagtatataccaccacccccctagtataccaccacccctcaacccggcccccaccgctaacaaagctgccggctgcaggaatgagagagtggtagaacgacacccccgtctcactccttgggactcctcagttgctggcggctccaagttttcaggagccacggtgttcccctcttccagatgctagtgccaacagtg

SEQ ID NO: 14115 - DNA, 201 bp, Homo sapiens
ggccagaagacggtgagtggaaagcccgggcgcgtggagagaccccaagaaggggctgttcagctgtgaatcctgcatttgccgttcgtgtttcatctggcggttttgaaaccaggttttcatctggacctctgtgagctgcatatccccggccagccacttccgctccagagggcccagatactggtagtgccggaagac

SEQ ID NO: 14116 - DNA, 207 bp, Homo sapiens
gctcctgtgacccctgcagccagcgaaccagcacatccttggggctgaagccacgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggt

SEQ ID NO: 14117 - DNA, 201 bp, Homo sapiens
cccatggggcagccagaagggagatggttttcccctggagttggggtgctcggcagccccggctctcccctgactgcccaggccaacctccgcctcctcccgctggtccacggcctactggcttccgggtgcctgtcagcgtgtccttctgctggggtgctcctatggatgaccagcgcttgtgtcttcttcccctgatgt

SEQ ID NO: 14118 - DNA, 201 bp, Homo sapiens
gaagacgggtgatttctgcatttccatctgaggtaccggtttcatctcactagggagtgccagacagtgggcgcaggtcagtgggtgcgtgcaccgtgcgcgaagcagggcgaggcactgcctcacttgggaagcgcaaggggtcagggagttccctttccgagtcaaagaaaggggtgacggacgcacctggaaaatcgg

SEQ ID NO: 14119 - DNA, 201 bp, Homo sapiens
ggggcgtggcctcctggagggaaccagtgtggagatgcccgtgtgcctggggcgtggcctcccggagggagtcagtgtggagatgcccgtgtgcctggggcgtggcctactagagggagtcagtgtggagatgcccgtgtgcctggggcgtggcctcctggagggaaccagtgcggagatgtcggtgtgcctggggcgtgg

SEQ ID NO: 14120 - DNA, 201 bp, Homo sapiens
gacgctcctcacctcccagatggggtggtggcggggcagagacactcctcagttcccagatggggtcgcggcctggcagaggtgctccccacatcccagacgatgggtggccgggcagagacgctcctcacttcctagacgggatgacggccaggaagaggcgctcctcacttcccagactgggcggccgggcagaggggc

SEQ ID NO: 14121 - DNA, 201 bp, Homo sapiens
gagcacagcgccggcgggctggcactgctgggggactcggcgcaccctccacagctgctgtcccgggtggtaagcccctcactgcccggggctggtggggcggccagctgctcggagtgtggggcccgccaaggccatgtccacccagaacttgctctggcctaccgcgagcagccccagttcccgccccgcgtctccctc

SEQ ID NO: 14122 - DNA, 201 bp, Homo sapiens
ctcctgagtagctggggctacaggtgcccaccaccacgcccggctaattttttgtattttcagtagagatggggtttcaccgtgttagccaggatggtctcgatctcctgacgttgtgatccaccgcctcggcctcccgaaatgctgggattacaggcctgagccaccgcacccggccatatttatttatttttaatcaga

SEQ ID NO: 14123 - DNA, 201 bp, Homo sapiens
ccccctcctcccccgactggccccgcccccactgccggccccgcccccactgccggcccgggccccacccacgccggagctgctccatttaaggagattgcgcagctggaaagctacacgtgtgagcctagaggcgggtcccggttgcagacttgccatggcctccgaagcttctgtgcgtctaggggtgccccctggccg

SEQ ID NO: 14124 - DNA, 201 bp, Homo sapiens
gttagttagttattttgagatggagtcttgctctgtcgttcaggctgtagtgcagaaccgctctcttggttcactgcaacctccaccttccgggttcaagcgataatcctgcctcagcctcccaagtagctggaattacagacgtgcactaccacgcccaactaatttttgtatttttagtagagatggggtttcgccata

SEQ ID NO: 14125 - DNA, 201 bp, Homo sapiens
gcggtctcctctgacccagatcgtcttcaaatatcgaacgctgaattgggccgggcgcggtggctcccacctgtcatcccagcactttgggaggccgaggcgggcggattatgaggtcaggagatcgagaccatcctggctaacacggtgaaaccccgtctctactaaaaatacaaaaaaaaaaaattagccgggcgtgat

SEQ ID NO: 14126 - DNA, 201 bp, Homo sapiens
ctacctttgtctctcaccctgggggtttcatgaccccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgct

SEQ ID NO: 14127 - DNA, 380 bp, Homo sapiens
ctctactaaaatacaaaaaattggctgggggtggtggcacgtgcctgtagtcccagttacacgggaggctgaagcaggggaattgcttgaacccgggaggcggagattgcagtgagccgagatcgtgccattgcactccaatggcactccagcctgatgacagagcgagactccgtctcaaaaataataataaataaataaacaaacaaacaaaaattagctgggcgtggtggcgtgtgcctgtagtcccagctactcgggagactgaggcaggagaatcgcgggaacccgggaggcggaggttgcagtgagccgagaccgcgccactgccctgcagcatggagacagagctagactccgtctaaaaaaaaaaaaaaaaa

SEQ ID NO: 14128 - DNA, 201 bp, Homo sapiens
aggcgggcggatcacgaggtcaggagatcgagaccatcctggctaatacggtgaaaccccgtctctactaaaaatacaaaaaattagctgggcgtggcggcgggcacctctagtcccagctacttgggaggctgaggcaggagaatggcgtgaacccgggaggcggagcttgcagtgagccgagatcgcgccattgcactc

SEQ ID NO: 14129 - DNA, 201 bp, Homo sapiens
aaaaactagcccggcgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtg

SEQ ID NO: 14130 - DNA, 201 bp, Homo sapiens
acggcgaactgcggcgactgtgacgtgctcccccaccctctccccggtggacccttcctatttgccttcctcccaacccccaacaagcccccaccaccgacgacgtgagacgacgacggcatgggaccttccaccccgccagggccaatgaaccccacaccatgagctgcatgaggcatgagggagcccccaagggaggaa

SEQ ID NO: 14131 - DNA, 201 bp, Homo sapiens
gacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctgga

SEQ ID NO: 14132 - DNA, 201 bp, Homo sapiens
caaataattagggataaagagtatcatactgccgaacccattttatctttaattttttttttaaattttttacaaaaaattagccgggtgtggtggcgggcgcctgtagtctcagctactcagagactgaggcaggagaatggcgtgaacccgggaggaggagcttgcagtaagcggagatcgcgccactgcactacagcc

SEQ ID NO: 14133 - DNA, 201 bp, Homo sapiens
atctctgtgacccacaccctattcgtacactccctccccttttgaaaatccctaataaaaacttgctggttttacggctcaggggcatcacagaacctaccgacatgtgatgtctcccccggatgcccggctttaaaatttccctcttttgtactctgtccctttatttctcaacctggccgacgcttagggaaaacagaa

SEQ ID NO: 14134 - DNA, 201 bp, Homo sapiens
ctttggcgaactcttattgttataatcttaaaaacccggcccagggaggagcttattctccattttctatacaggcgacatatgtagaaacataatccgccgctgtgcctgtgcggccaggactccctctctacacgcaatgattcagctgaccagcccaagacatgctcggttttcacgcctgtttgtaggggcactgct

SEQ ID NO: 14135 - DNA, 201 bp, Homo sapiens
ttgggagtagaggtctttcggaaggcaccatctccagagcgtgtttctgagtaactctgaggatgggttccgggttatcactgtgtgttggaaacagcagcgcccaggctgccggaggaggctggtctccctggcaggtcctggctgtgtctagagttttgtgggtcctggagataaggctccggtttgaggcccctgggg

SEQ ID NO: 14136 - DNA, 201 bp, Homo sapiens
gcctgagcaggacaaggaccctagagtccaagagaatcctgatgatcagagaagggtccccgaggtcaccggggatgcacggtctgcatttcggcccctgcgggacaatggaggcctctctctccctttgtgcccgggcccgggcctctgcagacagacctccatacccagaggtgagaaatcagatataaccagacatcc

SEQ ID NO: 14137 - DNA, 201 bp, Homo sapiens
tcacatgctaggtcacaaaacaagtcttcagaaatttaagaagattgaaatcatatcaaccatctcttaaaaaaaataggtggccgggcgcggtggctcacgcctgtaatcccagcactttgggaggccgagacgggcggatcacgaggtcaggagatcgagaccatcctggctaacacggtgaaaccccgtctctactaa

SEQ ID NO: 14138 - DNA, 568 bp, Homo sapiens
ttagtatacagacacaaaaatgagaggtgacagcgtgctggcagccctcacagccctcgctccctctcggcacctcctcggccttggcgcccactctggccgcgtttgaggagcccttcagcccgtcgctgcactgtgggagcccctttctgggctggacaaggctggagccggctccctcagcttgcgggtaggtgtggagagagaggcgtgggcgggaaccgtggctgcaggctgcgcttgcgggccagctcgagttccgggtgggcgtgggcttggcaagccccgcactcggagcggccagccggcccgggcagtgaggagcttagcacctgggccagcagctgctgtgctcgacttctcgctgggccttagctgcctccccgccgggcagggctcgggacctgcagccctccatgcctgagcctccacccccgccgtgcgctcctgtgcagcccaagcctccccgacgagcgccaacccctgttccacggcgcccagtcccatcgactgcccaagggctgaggagtgcgggcacacggcgccggactggcaggcagctccacct

SEQ ID NO: 14139 - DNA, 201 bp, Homo sapiens
tctactaaaaatacaaaaaattagctgggcatcatggtgggtgcctgtagtcccagctactcgggaggctgaggcaggagaatggcgtgaacccgggaggcggagcttgcagtgagcggagatcgcgccgctgcactccagcctgggcgacagagcacgagtccgtctcaaaaaaagaaaaaaaagaaagaaaagaaaaga

SEQ ID NO: 14140 - DNA, 201 bp, Homo sapiens
gggctggccaaggccggagttggctccctctgcttgcggggaggtgtggagggagaggcgcaggtgggaaccagggctgtgtggggcgcttgtgggcaagcgtgagttccgggtgggagcgggctcggcaaacccattccagggtgccctgcccttcacaaagaaaactctccctggggctcccatgggcttctctgggat

SEQ ID NO: 14141 - DNA, 201 bp, Homo sapiens
tcccaagtagctgggactacaggcacccgccaccatgcctggctaattttttgtattttttagtacagatggggtttcatcgtgttaaccaggatggtctcgatctcctgacctcgtgatctgcccgccttggcctctcaaagtgccgggattacaggcgtgagccaccgtgcccagccatataccacattttctttatcc

SEQ ID NO: 14142 - DNA, 201 bp, Homo sapiens
aaccatggggtgaactttgttatggggacatgcacctggggggaaggttgtgatgggaggggcacccgggtcaaacacgggcggttgttagtgaagagcccgcaagacagagtaggagtcagggggaacagggagggaggggcatttttttctttcttttttgagacggagtctcactctgtcccccaggctggagtgcag

SEQ ID NO: 14143 - DNA, 201 bp, Homo sapiens
cacaggagcacaaaagggctggcggccttgcccgggtacactgttcgtcttctcacctactcgtgcacctcagtttatcatccctgagctgggcgtagcacgtggttcagagaacgggaagggacctacgagtgcctgacacacataatcactgctgctggtgattacccttatccatgagtggcgcatggatggggctag

SEQ ID NO: 14144 - DNA, 201 bp, Homo sapiens
caaaggtctgcttctgcatttaagcatctgagccctcaagagttagctcccgggctcctctggagcaaggttccgcccggtcccacgtacctgcctcgtccgccgtgatggtgagctcgttgctgggctcgctcttgccaatccggttcttggcgtacatgcggatgctgtaggtggaggaagggtggatatcaatgatgg

SEQ ID NO: 14145 - DNA, 201 bp, Homo sapiens
cttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgc

SEQ ID NO: 14146 - DNA, 201 bp, Homo sapiens
ctcggcgtcggcatccaccagcgtggttagcttggccgaagcctcgcggaagggcgggatcaggcgccgcatcgtcgtgtccagggactggaattggcgccgcccgtaggtcatgaggcccaccatggagcccagcgccgcaccctgcgagaggggtggatgtgggggtcgcagggaccccagacggcccgggaccgaccc

SEQ ID NO: 14147 - DNA, 201 bp, Homo sapiens
tggtcaccttgggagcctgctgctgatgaactgcagcatggccatctgggccgtccatcctgcatggtcacgctgtccggccactgctgcaggtacgtcccgccccgctcaatttcctggctggtggggtcatccgggtgtctgtacacgatcttctctgagagggtcagaggccggttcaatcatttgcaaacaatgtta

SEQ ID NO: 14148 - DNA, 201 bp, Homo sapiens
ccagcacacaggacacccatgcgtgtttatcatccggcacacgggagacccacgcgtgtttactgtcgggcacaggggagacccacgcgtgtttactgttcggcacacgagagacccacgcgtgtttaccgtttggcacagggagacccacgcgtgtttactgtccggcacaggggagacccacgcgtgtttactgtccgg

SEQ ID NO: 14149 - DNA, 201 bp, Homo sapiens
aggggaacagcaatagaagctccacttatcaggtacctactgtgtgtcaagcattgtgccaagggcttcatagaataatagcataagaatctcggccgggcgcagtggctcactcctgtaatcccagcactttgggaggccgaggtgggtggatcacgaggtcaggagttagagagaccagcctagccaacatggtgaaac

SEQ ID NO: 14150 - DNA, 201 bp, Homo sapiens
tgcacgcaccgtgcgcgagccgaagcagggcgaggcattgcctcactcgggaagcacgaggggtcagggagttcccattcctagtcaaagaaaggggtgacggacgcacctggaaaatcgggtcactcccacccgaatactgcgcttttccggcgggcttaaaaaacggcgcaccacgagactatatcccacacctggctc

SEQ ID NO: 14151 - DNA, 201 bp, Homo sapiens
gcccgccaccacgcccggagaattttttgtatttttagtggagacaggttttcaccatgttagccaggatggtctcgatctcctgacctcgtgatctgcccgcctcggcctcgcaaagtgctgggattataggcgtgaggcacagcgcccggtcccgactgctctatttaaagtaatgaaagcacagttggctccaaagga

SEQ ID NO: 14152 - DNA, 201 bp, Homo sapiens
cctgcggtcagctggaccaggtggccggcagcgagacggaacaagtagaccaggctgagggtgaaggcgcaggcgatcagcagcatggacaagaggttgccgcctgccacctcctccatcgcctggcccagcacctacccacccgcctgtagcaagcccagcagcatcatcccggccgccgccgccatttcactctgtcgg

SEQ ID NO: 14153 - DNA, 201 bp, Homo sapiens
ccagactgctttttttttgagacagagtctcgctctgtcacccaggctagagtgcggaggcgcgatctcagctcactgcaagctccgcctcccgggttcacgccattctcctgcctcagctttgcgagtagctgggactacaggcgcctgccaccgcgccggctaatttttttggtatttttagtagagacagggtttcac

SEQ ID NO: 14154 - DNA, 201 bp, Homo sapiens
acagtctactaaaaatacaaaaaaaaaaaaaaaaaaatttgccgggtgtggtggtgtgtgcctgtaattccagccacttgggaggctgaggcaagagaatcgactgaacccgggaggcagagattgcagtgagcccagatcatgctactgcactccagcctggataagagtgagactccatctcaaaaacaaaaataaaaa

SEQ ID NO: 14155 - DNA, 201 bp, Homo sapiens
tgtttttttttgttttgagatggagtctcactctattgcccaggctggagtgcagtggtgccatcttggctcactgcaacctccacctcccgggttctagcgattctcctgcctcagcctcccaagtagctgggattgcaggtgctcacaaccacgcccggctaatttttgtgtttttagcagagtcggagtttcaccatg

SEQ ID NO: 14156 - DNA, 201 bp, Homo sapiens
tgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcaggt

SEQ ID NO: 14157 - DNA, 201 bp, Homo sapiens
gccaaggtgggcggatcacttgaggtcaggagttcgagaccagcctggccaacatggtgaaaccccatctctactaaaaatatggaaaaaattagccgggcggggctcgagcctgtaatcccagctacttgggagctgaggcgcgagaatcgcttgaagccgggagggggaggttgcaggagcagaggttgtgccactgca

SEQ ID NO: 14158 - DNA, 201 bp, Homo sapiens
ggtctgtatggtgcgtgattatcctcagtggaagtttcaacatgggtgtggctcagctttttagggtcccccaaggcagaggtggcccgggcccctgcagcgatctcacaacacacttcaactgcagacggtggagactgcgggctgtcctccggctcaagcggccctggggcccccgtcctgcgcggagccacccgtgtt

SEQ ID NO: 14159 - DNA, 201 bp, Homo sapiens
gcgttttgggttactgagagaagtgaaacactgcagatacggcagaggtgtttctcccctccctccgcccctagatgtggccttcacacgcaggctgatgcgctcccttcccatccacgcctgctcggttttgccacatatgccgctgtgctgccggccttgaatgtgtatgagcggctcgtgctggggtcagcggaggct

SEQ ID NO: 14160 - DNA, 234 bp, Homo sapiens
aggggctacactcatggatccccttctccttggcaggaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcaggg

SEQ ID NO: 14161 - DNA, 201 bp, Homo sapiens
ggggtcccttgtctccagcatcgccagcccaggtgtgttcctcatggcgtgatgcgtctgtagacttggaaacatcacaggacccaggtacttcacggagcgctcgctctgtgtcagccccagctcagcgcctcccagacaccgtctgacttcccggaggcagtcatcgacattgcgcccactgcacagatgagaaagctg

SEQ ID NO: 14162 - DNA, 201 bp, Homo sapiens
tccctagtgagatgaacccggtacctcagatggaaatgcagaaatcacccgtcttctgcgtcgctcacgctgggagctgtagaccggagctgttcctattcggccatcttggctcctccctcctgttttttttttgagacagtgtttcttttcacttctgtcacccaggctgcagtgcagtggcgcggtctgtgctcactg

SEQ ID NO: 14163 - DNA, 201 bp, Homo sapiens
taattttattttgtttttgagacagagtctcgctctgtcgcccaggctggagtgcagtggcgcaatctcggctcactgcaagctccgcctcccgggttcacgccattcgcctgcctcagcctcctgaataactgggactacaggcgtccgccaccacgcccggctaaatttttgtatttttagtagagacggggtttcatc

SEQ ID NO: 14164 - DNA, 201 bp, Homo sapiens
atccctagggctgcggatggcagaactaaaagagctaattagcaagtagaatcgccccttccggggcttcaaggtctgagcacccctcttggggtgccaccgcattcccttcggggtgacatgcctggtccagctgcaagccctgcctagaacctgcctgtgtaccggtgcttggaacagccagctggaccccacactcac

SEQ ID NO: 14165 - DNA, 201 bp, Homo sapiens
ggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcac

SEQ ID NO: 14166 - DNA, 201 bp, Homo sapiens
cacacacaggcgtggacactcacatggctcccggcagtgctgcaggaggtcagcacagagacgtgctgaggagcctgagatgctcgctcctctgggccatcgcgtgtaaaggctgccctcgctgtggactctcacatgtgtgacatacatgaacaggcgaaacggacacgcacggcccccacacacgtgagctgggtcccc

SEQ ID NO: 14167 - DNA, 201 bp, Homo sapiens
cccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatgga

SEQ ID NO: 14168 - DNA, 201 bp, Homo sapiens
gctgggcgtggtggcacgtgcctgcagtctcagctactcaggaggctgaggcaggagaatcccttgaacccgggacgcagaggttgcagtgagctgagatcgcgccactgcactccagcctggcaacagagtgagactccggctcaaaaaaaaaaaaaaagaaaaaaaaaaaaaaaagaaggagttgaggctttaagaact

SEQ ID NO: 14169 - DNA, 201 bp, Homo sapiens
ttgcactctgtgggtaggggacactcttctcagtggctggtgatgactgtgatcccacttgtcgagctctgtgggagtcccggcagtcctccgcaactgtcggctggttgttactgtctcagcgcctgccttctgattggttagcaaactacggtggtagacagaaaaaagatagccttcctttttagggctgtcctacaa

SEQ ID NO: 14170 - DNA, 201 bp, Homo sapiens
ccctgctggcgcaccctgctggcgcaccctgctggcgcaccctgctggcgcaccctgctggcgcaccctgctggcgcaccctgctggcgcaccctgctggcgcaagttgcgccttgggactgggcctgaaaagggaggagttattcatcttaagctttcaggcccggggagaatcttacagtaagccctctgggagtttga

SEQ ID NO: 14171 - DNA, 686 bp, Homo sapiens
gtggcacctgcaggctcccaggaccaggcagaggacccagcctccccaggactggggccccggcgctgcgctccaggggaggccgacgggggctgggaggcgcccagggcgggaatccagcgcacgggtgaggactttaaaaagcaaggggcaggatgagtcaacaaggttttgagcaggaaaactatgcgataggaagtgtatacattgccctatagcagaaagaccggggacgggaccagcctccaagcgacttcaaacccaaaaggaagcaacttccagactcttatgggcgtctcaatttgctctgggtgaaggaagacaggcaagaatttccaggtctgtgaggaccccacgtcccagggacagaagtgccagggacctgggaagtgcagacttaatacaaggcagagcaaaactcacgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcggggccgggaccagacctgtgcatctctccgcctcgcacccagcgcctctgtttttcgggtgtttggaggtgagagcggccaggaaggctgaggcatgat

SEQ ID NO: 14172 - DNA, 201 bp, Homo sapiens
gctagagtgcagtggtgcgatctcggctcactgcaagctccgcctcccgggttcacgccattctcctgcctcagcctccccagcagctgggacaggggcacgccgccacgcccggctagtttttgtatttttagtagagacggggtttcaccatattagccaggacggtctcgatctcctgacctcgtgatctgccagcct

SEQ ID NO: 14173 - DNA, 201 bp, Homo sapiens
gccagagaccctgtctctaaaagcaaaaaagaaaaaaaaagcccttttccaagttattacacactctgaataattaatattgaaaactgttggccgggcgcggtggctcacgcctgtaatcccagcactttgggaggccgaggcggggcggatcacgagatcagcagaacggcgtgaacccggaaggcggagcttgcagtg

SEQ ID NO: 14174 - DNA, 201 bp, Homo sapiens
ctgcatttccatctgaggtaccgggttcatctcactagggagtgccagacagtgggcgcaggtcagtgggtgcgtgcaccgtgtgcgagccgaagcagggcgaggcactgcctcacttgggaagcgcaaggggtcagggagttccctttctgagtcaaagaaaggggtgacggacgcaccttgaaaatcgggtcactccca

SEQ ID NO: 14175 - DNA, 201 bp, Homo sapiens
acgcacccactgacctgcgcccactgtctggcagtccctagtgagatgaacccggtacctcagttggaaatgcagaaatcaccatcttctgtgtcgctcacgctgggagctgtagaccggagctgttcctattcggccatgttggctcctcccccggatataaccattcttgtacttatttaattttcatttttatggaat

SEQ ID NO: 14176 - DNA, 201 bp, Homo sapiens
ttttcatgtgactactgcctgcctgtcagcgctagcctcttctgactctaaattacaagtggaagaaagcacgttagaaacccacagaactggcccggcgcggtggttcaggtctgtaatcccagcactttgggaggccgaggcaggcggaccacgaggtcaggagatcgagaccatcctggctaacagggtgaaaccccg

SEQ ID NO: 14177 - DNA, 201 bp, Homo sapiens
aagtcttttttttttttttttttttttttttttgagacggagtctcactctttcgcccaagctggactgcagtggcgctatcccggctcactgcaagctccgcctcttgggttcatgccattcttctgcctcagcctcccgagtagctgggattacaggcgcccaccaccacgcccggctaattttttgtatttttagtag

SEQ ID NO: 14178 - DNA, 201 bp, Homo sapiens
cgcctggtgcatgctgtggagggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccgccttccccctccccaccctcaccaccctcc

SEQ ID NO: 14179 - DNA, 201 bp, Homo sapiens
gactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtag

SEQ ID NO: 14180 - DNA, 201 bp, Homo sapiens
ggcactttatttatttagagacagagtctcgctgcgacgcccaggttggagtgcatggcgcaatcttggctcactgcaggctccgcctcccgggttccagcgattctcctgcctcagcctcccgagtagctggggttacagttatgtgccaccacgccgggctaatttttgtatttttagtagagacagggtttccccata

SEQ ID NO: 14181 - DNA, 201 bp, Homo sapiens
ccaccatgcccaactaattttttctatttgtagtagagacagggtttcactgtgttagccaggatggtctcgatctcctgaccttgtgatccgcgtgtctcggcctcccaaagtgctgggattacaggcgtgagctaccgcgcccggcttgtaaatattttctgcgcttcagtgggccatgtcttcactttgttgattgct

SEQ ID NO: 14182 - DNA, 227 bp, Homo sapiens
tcagcctcctgagtagctggaactacaggtgcccgccaccacgcccggcttattttctgtatttttagtagagacggggtttcaccatgttagccaggatcgtcttgatctcctgacctcgtgatccgccggcctcggcctcccaaagtgctgggattacaggcgtgagccaccacgcccagccctagaaattgaaatgcatattattaagtgaaagaagccaatct

SEQ ID NO: 14183 - DNA, 201 bp, Homo sapiens
ccctcccccagccttgctgccaccttgcagtttgatctcagactgctgtgctagcaatcagcgagactccgagccaggtgtgggatataatctcgtggtgcgccgttttttaagccggtcggaaaagcgcaatattcgggtgggagtgacccgattttccaggtgcgtccgtcacccctttctttgactcggaaagggaac

SEQ ID NO: 14184 - DNA, 201 bp, Homo sapiens
aggtgcgtctgtcacccctttctttgactcggaaagggaactccctgaccccttgcgcttcccaagtgaggcaatgcctctccctgcttcggctcgcgcacggtgcatgcccccactgacctgcgcccactgtctggctctcccaagtgagatgaacccggtacctcagatggaaatgcagaaatcacccgtcttctgcgt

SEQ ID NO: 14185 - DNA, 201 bp, Homo sapiens
tgcctttttgtttcagtgctcatactgtaaaaaagtgtcctttccaccgggcgcggtggctcacgcctgtaatcccagcactttgggaggcagaggcgggcggatcacgaggtcaggagatcgaaaccatcctggctaacacggtgaaaccccgtctgtactgtgaatacaaaaaattagccgggcgtggtggcgggtgcc

SEQ ID NO: 14186 - DNA, 201 bp, Homo sapiens
gccgggcgtggtggcgggcacctgtagtcccagctactcgggaggctgaggcaggagaatggggtgaacccgggaggcggagcttgcagtgagccgagatcgcgccactgcactccagcctgggtgacagagcgagactccatttcaaaaaaaaacaatactaggattgaagtttgcttcctaacttccagtgacacggtt

SEQ ID NO: 14187 - DNA, 201 bp, Homo sapiens
tgaacaagaaagggccattacattttattctgaaatggcccctggagaaagaatggaagcaaattgcacaagtgggcgtccatctccttccacccggccacggtcaccgtggtgctcggccaggctcctggtgacgtgaggcaaatctctccgctggcaaaccagcccacacactccctccattgcagacggtcacccaga

SEQ ID NO: 14188 - DNA, 201 bp, Homo sapiens
ctaagcaccttcctgtgacccgctcagaggaacccctggcagtggggatggcgtcacccccatttgagagatgaggagactgaggctcagaggggggacgcggcttgcccgagtcacactgattgagaggggcagacctggattcgtctgcagcccaagctcttagagaccccggtgtggcctgccgggcagccagcttgt

SEQ ID NO: 14189 - DNA, 201 bp, Homo sapiens
gtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctggg

SEQ ID NO: 14190 - DNA, 201 bp, Homo sapiens
cccggatacccaggtcatctccgaatctcaaggtccttaatcgtagtcacacgtacagaggcttctttgccatgtggggtaatacggtcacagggtaagacggtcacgggtctcagacatctttgggccattatcctgtctaccgcaggtggacacagccatggaatggaagcaacttttctgattacctacggtagcttt

SEQ ID NO: 14191 - DNA, 201 bp, Homo sapiens
gattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccgccac

SEQ ID NO: 14192 - DNA, 201 bp, Homo sapiens
ccttgaatagcagcaggtagtagagccccagggagagcaggtccccgtggtgcagcaccacggtcctgtgccccacctcggagaagttgacggagatgtgcgccccggggatgggctccaggaccagcctccccgcggcctggccgctgtccgggagcggttgccggcggatggtgcagtgtagaggcaggatgtcggggg

SEQ ID NO: 14193 - DNA, 201 bp, Homo sapiens
acagggtttcaccctgttagccaggatggtctcgatctcctgacctcgtgatccgccagcctcggcctcccaaagtgctgggattacaggcgtgagccaccgcattgggccggcagttatctttcttaagtagcagttctatttctcagtataaattaatgctgcagttcctaaaccatttgctgaagtgcctctgaaccc

SEQ ID NO: 14194 - DNA, 201 bp, Homo sapiens
ttttttttttttttttgagacagaattttgctctgttgcccaggctggagcacagtggtgcgatatcagctcactgcaaactccacctcccgggttcaagcgattttcctgcctcagcctcctgagtatctgggattacagggagtgcctccacacctggctaattttttgtatttttagtagagacagggtttcaccgtg

SEQ ID NO: 14195 - DNA, 201 bp, Homo sapiens
aacagctgggcgcggtggctcacacctgtaatcccagcactttgggaggctgaggcgggtagatcacgaggtcaggaaatcgagaccatcctggctagcacggtgaaaccccgtctccactaaaaatacaaaaaaaattagccgggcgttgtggcggacgcctgtagtcccagctactcctaaggctgaggcaggagaatg

SEQ ID NO: 14196 - DNA, 201 bp, Homo sapiens
ttgactcggaaagggaactccctgaccccttgcgcttcccaagtgaggcaatgccttgccctgctttggctggcgcacggtgcgcgcacccactgacctgcgcccactgtctggccctccctagtgagatgaacccggtacctcagatggaaatgcagaaatcacccgtcttctgcatcgctcacgctgggagctgtagac

SEQ ID NO: 14197 - DNA, 201 bp, Homo sapiens
tttttattttgttttttagacagaatctcgttgtgtcacccaggctggagtgcagtggcgtgatcttggctcactgcaacttctgcctcccgggttcacgcgattcttctgcttcagcctcccaagcagctgggattgcaggtgtgcaccaccatgcccatactaagtctttgtatttttagtagagatggggttttgcca

SEQ ID NO: 14198 - DNA, 201 bp, Homo sapiens
cagtgaaaccccgtctctactaaaaatacaaaaaattagcccggcgtggtgaagggcacctgtagtcgcagctactcaggaggctgaggcaggagaatggcgtgaacccgggaggtggagcttgcagtgaaccgagatcacgctactgcactccagcctgggcgacagagtgagactctgcctcaaagaaatagaagattt

SEQ ID NO: 14199 - DNA, 201 bp, Homo sapiens
ctctgtgaaaaataaaaaaaataagccgggcgcggtggctcacgcctgtaatcccagcactttgggaggccgaagcaggcagatcacgaggtcaggagatcgagaccatcctggctaacgcggtgaaaccccgtctctactaaaaatacaaaatattagccgggcgtagtggcgggcgcctgtagtcccagctactcggga

SEQ ID NO: 14200 - DNA, 201 bp, Homo sapiens
gagctaaagtgatacgtctgcctgggcctcccaaagtgctggaattacagatctgagccaccgggcccagcccaattactttcttcagtctgagtatgagcgccggaagaaaagctcctacctgcatctattttttttagacacagggtctccctctgtcacccaggctggagagcagtggcgcaatctccgctcggctca

SEQ ID NO: 14201 - DNA, 201 bp, Homo sapiens
ggagcatgaggcaggagagtcacttgaacccgggaggcagaggttgctgtgagccgagatcatacctctttactccagcctgagtggcagagcaagactccgtctcaaaaaaaaaaaaaaaaagttgggggaaggagagaaaaatagagagcccagtggggcaaccccccacccagcccttgccacctgccactgctccag

SEQ ID NO: 14202 - DNA, 201 bp, Homo sapiens
atatctggtttctgggatttgcacacctttgtccctcttgggtggaaagacggcttccctgaccagggctcccctgtgttccagagggcacgttccctttcgtaagtgtgagtcgcacaccagtgagcatgtgtctccacttccagggacaccggccactaggcttggggttagatggtaggactctcgtccctcccttca

SEQ ID NO: 14203 - DNA, 201 bp, Homo sapiens
ctacaggcgcccgccaccacgcccggctaattttttgtgttttgtttagtagagacggggtttcaccgtattagccaggatggtctcgatctgctgacctcgtgatccgcccgcctcggcctcccaaagtgctgggattacaggcgtgagccaccttgcgcccggcctctttatttttatatctcaaatcagagatgattt

SEQ ID NO: 14204 - DNA, 217 bp, Homo sapiens
tacaggcgccccccaccacgcccggctaattttttgtatttttagtagagacggggcttcaccgcgttagccaggatggtctcgatctcctgaccgagaccgcgccttcctgaccgcgcccggccgaccctcctcttttttctatttgttttttctctttttatcattatcaaaagcccattgtcccatactttctccttcctaatttcattcaaaa

SEQ ID NO: 14205 - DNA, 217 bp, Homo sapiens
ggtctacagctcccagcttgagcgacgcagaagacgggtgatttctgcatttccatctgaggtaccgggttcatctcactagggagtgccagacagtgggcgcaggtcagtgagtgcgtgcaccgtgcgcgagccgaagcagggcgaggcactgcctcacttgggaagggcaaggggtcagggagttccctttcccagtcaaagaaaggggtgacgg

SEQ ID NO: 14206 - DNA, 201 bp, Homo sapiens
gcccgccaccacgcccggctaaatttttgtatttttagtagagatggggtttcaccttgttaaccaggatggtgtcgatttcctgacctcgtgatccgcccgccttggcctcccaaagtgccgggattacaggcgtgagccactgcgcccggcctggaaattgttttttatgtagttgatccattttaactcccaccagca

SEQ ID NO: 14207 - DNA, 201 bp, Homo sapiens
tatatgaccctgaataagtcctgaattatccacatgtgactttccggtctcatatgaggcagaacagcacggtgtggaccgggaaccctgacgtgggagccgaaagatggggaggctgtgggcacggcccccggagccccgggactgagacatgcaggcacctcagacgggtttgctgccacaataagtgggaaatctcca

SEQ ID NO: 14208 - DNA, 201 bp, Homo sapiens
cccagagaagacccggcagcccctccagccctcggcctctgtccccgcctccttccctcctgtcctcaggcctcctctctgcagcctcccagtctcccaccgcgtcctgcgctcctggttttctcctcttctagtgtcttccccacctggcgtcgcccggccgcaaccctggccctcctggggaagaggttcggaccctac

SEQ ID NO: 14209 - DNA, 201 bp, Homo sapiens
tgtttccacattggaaaaattcaaacacctttaagagtctgactatcggccgggcgcggtggcttaacgcctgtaatcccagcactttgggaggccgaggcggccggatcacaaggtcaggagatcgtgaccatcctggctaacacggtgaaaccccgactctactaaaaaaatacaaaaaaattagccgggcgcggtggc

SEQ ID NO: 14210 - DNA, 201 bp, Homo sapiens
gatttggttgtttagaagcgtgtgccactccggatcgagccaagatggccgaataggaacagctccggtctacagctcccactgtgagcgacgcagaagacgggtgatttctgtatttccatctgaggtaccgggttcatctcactagggagtgccagacagtgggtgcaggtcagtgggtgcgcgcaccgtgcgtgagct

SEQ ID NO: 14211 - DNA, 201 bp, Homo sapiens
cttcggccgggcgccgtggctcacgcctgtaatcccagtgagaggtgatagcatgctggcagccctcgcagccctccctcaccagcgcgacttccgggtgcgcgtgggctgggctggcccgcacttggagcggccagcagccccgggcagtgaggggcttagcacctgggccagcagctgctgtgctcgacttctcgccag

SEQ ID NO: 14212 - DNA, 201 bp, Homo sapiens
tgcggccgggcgcggtggctcactcctgcaatcccagaactttgggaggccgaggcgggcggatcacgagatcagcagattgagaccatcctggctaacacggtgaaaccccgtctctattaaaaatacagaaaaagtagccgggcgtggtggcgggcacctgtagtcccagctacaggctgaggcagaagaatggcgtga

SEQ ID NO: 14213 - DNA, 201 bp, Homo sapiens
cctcggcctcccaaagtgctggggttacaggcgtgagccaccgcgcccggtcagccgtccctactaaaaatacaaaaaattagcctggcgtggtggcgggcgcctgtagtcccagctactccggaggctgaggcaggggaattgcttgaacccatgaggcggaggttctaagccgaggtcgtgccactgcactccagtctg

SEQ ID NO: 14214 - DNA, 201 bp, Homo sapiens
ggctggagtgcagtggcgtgatctcggctcgctacaaccttcacctcccagcagcctgccttggcctcccaaagtgccgagattgcagcctctgcccggccgccaccccgtctgagaagtgaggagcgtctctgcctggccgccatcccatctaggaagtgaggagcgcctcttcccggccgctatcccatctgggaagtg

SEQ ID NO: 14215 - DNA, 201 bp, Homo sapiens
gccttagctgccttcccgcggggcagggctcgggacctgcagcccgccatgcctgagcctcccaccccttccgtgggctcctgtgcggcccgagcctccccgacgagcgccaccccctgctccacggcacccagtcccattgaccacccaagggctgaggagtgcgggcgcacagtaccgggactggcaggcagctccatc

SEQ ID NO: 14216 - DNA, 286 bp, Homo sapiens
gaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaggggtcagagagttccctttccgagtcaaataaatgggtgacggacgcacctggaaaatcgggtcactcccacccgattattgcgcttttcagaccggcttaaaaaacggtgcaccacgagactatatcccacacctggctc

SEQ ID NO: 14217 - DNA, 201 bp, Homo sapiens
gcctcagctgcctccctgcggggcagggcttgggacctgcagcctgccatgtgtgagcctccccccactgccctaggctcctgtgcagcaggagcctccccgacgagcaccgccccctgctccatggcacccggtcccatcgactgtggaacggctgaggagcgtgggcacaaggcatgggactggcaggcagctttgcct

SEQ ID NO: 14218 - DNA, 201 bp, Homo sapiens
ggagtgcaatggcaccatctcggctcactgcaacctccgcctcccgggttcaggcgattctcttgcctcagcctcccgagtatctgggattacaggcgcgcgcctccacgcccaactaatttttgtatttttagtagagacggagtttcaccatgttggccaggctcgtctcgaacccctgacctcgtgatccacccgcct

SEQ ID NO: 14219 - DNA, 201 bp, Homo sapiens
cctccgtcaccccttcctttgactcggaaagggaactccctgaccccttgcgcttcccgagtgaggcaatgcctcgccctgcttcggctcgcgcacattgcgcacacccactgacctgcgcccactgtctggcactccctagtgagatgaacccggtacctcagatggaaatgcagaaatcacccgtcttctgcgtcgctc

SEQ ID NO: 14220 - DNA, 201 bp, Homo sapiens
gacgcagaagacgggtgatttctgcatttccatctgaggtaccgggttcatctcactagggagtgccagacagtgggcgcaggtccgtgggtgcatgcaccgtgtgcgagctgaagcagggcgaggcattgcctcactccggaagcgcagggggtcagggagttccctttcctagtcaaagaaaggggtgacagacggcac

SEQ ID NO: 14221 - DNA, 201 bp, Homo sapiens
cccagctaattttttttatatttttaatagagacagggtttcaccatgttggccaggatagtcttgatctcttgacctcgtgatccgcccgcctcggccccgcaaagtgctgggattacaggcgtgagccaccgcacccggccggaagtatacattttaacagctctacatagtagctgctgtcagaattcaaatgaagat

SEQ ID NO: 14222 - DNA, 201 bp, Homo sapiens
cagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttctgagtcagggaaaggggtgacggatggcacctgg

SEQ ID NO: 14223 - DNA, 201 bp, Homo sapiens
ctggcagggccggccggctgctcccagtgcggggcctgccaagcccacgcccacccggaactccagctggcccgcaagcaccatgcacagcctgggttcccgctcacgcctctccatccacacctccctgcaagctgagggagcgggctctggccttggccagcccagaaaggggctctcacagtgcagcggtgggctgaa

SEQ ID NO: 14224 - DNA, 201 bp, Homo sapiens
cttgagattctcgcagccccggggcctgagctgaggggtcaccggcagtgccgtgggagtcaggctgccctcccggaagccaggctgctcctgagcagagcggaggctccatcgccctccggggggcacggtggcagtctccaggctgcactggggttggatgagctgggggtggagcacaaggggtcagtccctctcccc

SEQ ID NO: 14225 - DNA, 201 bp, Homo sapiens
aaacccctcgtctgcagggggcgggtggggaggtggaggaggggctgggccaaacgctgggggtgtgacccggggctgcgggctctcgggtctcagtcttcgggtctgccgagtgggcgagtggggtgcctcactccctgcggtctcttcccggtccccacagaacatggagaaggcgactctgccgtcggtgacgctcat

SEQ ID NO: 14226 - DNA, 201 bp, Homo sapiens
gggcgcctgtagtcccagctactcgggaggctgaggcaggagaatggcatgaacccgggaggcggagcttgcagtgagccgagatcgcgccactgcacttcggcctgggcgacagagcgagactccgtcaaaaaaaaaaaaaaaaagcagtcttgcaagatcaggtgtctggtagacaggcacactcagtaaagttacaac

SEQ ID NO: 14227 - DNA, 210 bp, Homo sapiens
ctactaaaaatacaaaaaaattagcctggcgcggtggcgggcgcctctagtcccagctgctcgggaggctgaggcaggagaatggcgtgaatccgggaggcggagcttgcggtgagccgagatcctgccacagcactccagcccgggcgacagagtgagacttcgtctcagaaaaaaaaaaaaaaaaaaaaaagaagtgggaacccagaa

SEQ ID NO: 14228 - DNA, 201 bp, Homo sapiens
ccccgggttcacgccattctctcgcctcagcctcccgagtagctgggactacaggcacccggctaattttttgtattttttatagagacggggttctcaccgtgttagccaggatggtcttgatctcctgacctcgtgatccgcctgcctgggcctcccaaagtgctgggattacaggcgtgagccaccgcgcccagcttg

SEQ ID NO: 14229 - DNA, 201 bp, Homo sapiens
gaccgttttctcgccattgtacccacacaacttgctctaaatgggcaatttattaagtatattttgtccctgttcccgccgcaggcccctgccggaccgtcgcccacaagctcccatagcccgtgagtcctctcagcctggcccggctcaccctgtggcgcccacgtctaccccgggccctttccgattcctctttaaccc

SEQ ID NO: 14230 - DNA, 201 bp, Homo sapiens
gtagtgcagtggcgcaatctcggctcactgcaagctccgcctcccgggttcacgccattctcctgcctcagcctccgggctagctgggactacaggcgcccgccactgtgccaggctaattttttgtatttttagtagagatggggtttcaccatattagccaggatggtctcgatctcctgacttcgtgacccacccgcc

SEQ ID NO: 14231 - DNA, 201 bp, Homo sapiens
tccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaac

SEQ ID NO: 14232 - DNA, 201 bp, Homo sapiens
ggaacaaacattcctgttccacaaagacccagaattcactggatactgataaaatgtttactagaggccggcgcagtggctcatgcccataatcccggcgcggtggctcacacctgtaatcccgacgtggtggctcacacatgtaatcccagcacttcgcaaggccaggtggggggatcacttgagctcaggagttcatga

SEQ ID NO: 14233 - DNA, 201 bp, Homo sapiens
gtggtgcaattttggctcactgcaagctctgcctcccgggttcatgccattctcctgcctcaggctcccgagtagctgggactacaggtgcacaccaccacgcccggctaatttttttgtatttttagtaaagacggggtttcaccatgttagccaggatggtctcgatctcctgaccttgtgatccaccagcctcagcct

SEQ ID NO: 14234 - DNA, 201 bp, Homo sapiens
gtaaaccttctgcaaaatcctggccctccagaccccagctgggtcctcccctccaggcccccagtggcagctgtgccccttgtgtgcccacgtcggccagcgcaagccacacatggacccagtgcccactgcacccctgccagcctcagggtcccagcccgttgttccgggagacttcagtcctggcccaggcatctcctt

SEQ ID NO: 14235 - DNA, 201 bp, Homo sapiens
ttttaatttttttattaagatggagtcttgctctatcgcccaggctggagtgcagtggcgcgatcacggctcactacaacctccgcctcccgggctcaagcgattctcctgcctcagcctcccgagtagctgggattacaggcatgtgccaccatgcccaggtaattttagtacttttagttgagacggggtttcaccatg

SEQ ID NO: 14236 - DNA, 201 bp, Homo sapiens
ccccgccaggcgcggtggctcatgcctgtaatcccagcactttggaacgccgaggcaggcgaatcacgaggtcaagagatcgagactatccttgctaacacggtgaaaccccgtctctaccaaaaatacaaaaaattagccgggcgtgggggcgggcgcctgtagtcctagctgctcgggaggctgaggcaggagaatcgc

SEQ ID NO: 14237 - DNA, 201 bp, Homo sapiens
attattttctttttttttgagacggagtcttgctctgtcgcccacgctggggtgcagtggcacgatctcggctcactgcaagctccgcctcccgggttcacgccattctcctgtctcaacctctcgagtagctgggactacaggcacatgctaccacacccggctaatttttttgaatttttagtagagaggggtttcact

SEQ ID NO: 14238 - DNA, 201 bp, Homo sapiens
tccgcgaatccgggtggtgtccttttcttgtactattcagacgtgtttctaggaaggacgtgctgtcatgacccgccatggtggtcccggggatggtcagcggcgggatgatgggtgtgatgtggtcccggggatggtcagcggcaggatgatgggtgtgacgcatctgtgctacttgggattcaaattcatctatgatct

SEQ ID NO: 14239 - DNA, 201 bp, Homo sapiens
actgggtttcaccgtgttagccaggatggtctcgatttcctgaccttgtgatcagcccgcctcggcctcccaaagtgctggtattacaggcgtgagccaccgctcccggcaaagtcctttttcgatggtttcagtttgctggacaagccaggaacaaggccattggttgcaagggaggaggagctcttgtaggtggcagcg

SEQ ID NO: 14240 - DNA, 201 bp, Homo sapiens
ggtgactcaaatcgttcatgtggaacacacacacacacacacatatacacacacacgtgtcttagggacggacacacacaaacacgtgtcttaggggccccgtgtgaggagaggagattcacactactgacccagcaaccagggtcgaccccagagggctggagcacacactccgggttgacgataggcgcctggctctgg

SEQ ID NO: 14241 - DNA, 201 bp, Homo sapiens
cctcggcccgtccctttttacctcaggctgcctcaacctctccctgaaagcctggcgtccattccccatttcctgggaaacatcttgtcgctttggggtgcgccccgtgaaggagacacgctgggtgaaagccagggactccacaaccaccccccgcccccaccccgggcccagtgcaggggctgccgtgaaggcactggc

SEQ ID NO: 14242 - DNA, 201 bp, Homo sapiens
aggctgctgggaaggaactggcctccatggaagtgccccagccttcttgccctcccggcttttttcccccggctgtctcagtgtcccactgaaagcctggcgtcatatccccatcccccgggaaacttcatgcccctttggggtgccccccgtggggaagacacgcaccctgggtgaaagctagggactccatgaacaccc

SEQ ID NO: 14243 - DNA, 201 bp, Homo sapiens
accaacccaaatatccatcaatgatagactggataaagaaaatgtggtggggtggagccaagatggccgaataggaacagctccggtctacagctcccagcgtgagcgacgcagaagatgggtgatttctgcatttccaactgaggtaacgggttcatctcactggggagtgctggacagttggtgcaggacagtgggtgc

SEQ ID NO: 14244 - DNA, 201 bp, Homo sapiens
gcccgccaccacacccggctaattttttgtatttttaatagagacggggtttcaccgtgttagcaaggatggtctcgatctcctggcctcgtgatccgcccgcgtcggcctcccgaagtgctgggattacaggcatgagccaccgcgcccggccagaagtgtttttatctgtttgggaagttgcctctccctggcacctgc

SEQ ID NO: 14245 - DNA, 201 bp, Homo sapiens
tttttcatcttaaggaacaagttcttaattagattagatacagctataagtaaacataaactatgttcttatgtaacctcaagagttattttaggccgggcgcggtggctcatgcctgtaatcacagcactttcggaggccgtggcgggcggatcacgaggtcaggagattgagaccatcctggctaacatggtgaaacca

SEQ ID NO: 14246 - DNA, 201 bp, Homo sapiens
ggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccg

SEQ ID NO: 14247 - DNA, 366 bp, Homo sapiens
tgagcgacgcagaagacgggtgatttctgcatttccatctgaggtaccgggttcacctcactagggagtgccaggcagtgggcgcaggccagtgggtgcgcgcaccgtgggcgagccgaagcagggcgaggcattgcctcacctgggaagcgccaggggtcagggagttccctttccgagtcaaggaaaggggtgaccgacgcacctagaaaatcgggtcactcccacccgaatattgcgcttttcagaccggcttaaaaaatggcgcaccacgagactatatcccacacctggcttggagggtcctacgcccacggaatctcactgattgctagcacagcagtctgagatcaaactgcaaggcgg

SEQ ID NO: 14248 - DNA, 201 bp, Homo sapiens
ataaaggttctccaagtccacactagactcacgagcccagctggcttcacccagtggatcccgcaccgggggccgcaggtggagctgcctgccagtcccgcgcagtgctcccacagtcctcagcccttgggcggtcgatgggaccgggcgccgtggagcagggggcagcgctcattggggaggctcggccctgcaggagcc

SEQ ID NO: 14249 - DNA, 201 bp, Homo sapiens
ggtgccgtctgtcacccctttctttgactaggaaagggaactccctgaccccttgtgcttccggagtgaggcaatgcctcgccctgcttcggctcgcgtgcggtgcgctgcacccactgtcctgcgcccactgtctggcactccctagtgagatgaacccggtacctcatatggaaatgcagaaatcactcatcttctgcg

SEQ ID NO: 14250 - DNA, 201 bp, Homo sapiens
gccgccttgcagtttgatctcagactgctgtgctagcaatcagcgagactccgtgggcataggaccctccgagccaggtgcgggatacaatctccaggtgcgccgttttttaagcctgttggaaaagtgcagtattccggttggagtgacccgattttccaggtgctgtctgtcacccctttctttgactgggaaagggaa

SEQ ID NO: 14251 - DNA, 384 bp, Homo sapiens
ctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaa

SEQ ID NO: 14252 - DNA, 216 bp, Homo sapiens
gaagacgggtgatttctgcatttccatctgaggtaccgggttaatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgatggacgcagctggaaaatcgggtcactccca

SEQ ID NO: 14253 - DNA, 334 bp, Homo sapiens
tgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacag

SEQ ID NO: 14254 - DNA, 201 bp, Homo sapiens
gggatcctaaggtcttgctggtgcggcccaaaggcaccggacgttggggccaagatgacctccgcgctgccatgaaccaggccattggacgcgggctccgcgccgagcctgcagtcctcgaggagtctctcgggttcctccgttttgatcacaccttctcggatggctgccgggcttttgcctgccccgccttgcatcgag

SEQ ID NO: 14255 - DNA, 270 bp, Homo sapiens
gccactgcactccagcatgggtgacagagccagcctgaaactctgccctgcgtccttctgagaagtgacagtgtaccggcatggcagccctcacagccctcgctcgctcttggcgcctcctcggccttggcacccactctggccgcgcttgaggagcccttcagcccgccgctgcactgtggaagcccattcctgggctggccaaggccggagccggctccctcagcttgcggggaggtgtggagggagaggcacgggcgggaaccgggg

SEQ ID NO: 14256 - DNA, 253 bp, Homo sapiens
cgtgagcgacgtggaagacaggtgatttctgcatttccatctgaggtaccgggttcatctcactagggagtgccagacagtgggcgcaggtcagtgggtgcgcgcaccgtgcgcgagccgaagcagggcgaggcattgcctcacttgggaagcgcaaggggtcagggagttccgtttccgagtcaaagaaaggggtgacggacgcacctggaaaatcgggtcactcccaccggaatactgcgcttttccgacc

SEQ ID NO: 14257 - DNA, 204 bp, Homo sapiens
tcccagtaggggcggccgggcagaggcgcccctcacctcccggacggggcggctggccgggcaggggggctgaccccccccacctccctcccggacggggcggcggcaaagactgagacagctccgctgcccgctgaactccatcctcccggccaaaaccaagcttcttaacaaagatcctgaagtgttgagtttactaattta

SEQ ID NO: 14258 - DNA, 228 bp, Homo sapiens
gctaccttgcagtttgatctcagactgctgtgctagcaatcggcgagactccgtgggcgtaggaccctccgagccaggtgcgggatatagtctcctgatgcgccggtttttaagcccgtaggaaaagcgcagtattcgggtgggagaggcctgattttccacgtgctgtctgtcacccctttccttgaccaggaaagggaactccctgaccccttgtgcttcccgagt

SEQ ID NO: 14259 - DNA, 217 bp, Homo sapiens
cgcaggatgcagattgcagacgctcatcgtctcgcaggcagctccagctcgagtggtggccgtgctgggtctgtgcccggggccttcccccgtatgctttcgctttctagtgtctgcgatgacgtgcgattcactaatcacccggactcagcgcatctctatgttaaatagcgcgtgtccatctgcaaagcacacgacagcccctgcggccactggg

SEQ ID NO: 14260 - DNA, 201 bp, Homo sapiens
tcattcttgaagtcactgagaccacaagcccactggaaggaaccaactccggacacatcttgggtgttcgtctgggatattgccacacggtgagtaccatcggactcgtctgggatattgccacacggtgagtaccttcggacctgtttcactttctattctgccctatttttccttagaattcaggggttaaacaccgga

SEQ ID NO: 14261 - DNA, 204 bp, Homo sapiens
aagacaacaaactggtcctaaataaaaagtaagaaaaatgccggggaggagccaagatggccaaataggaacagctccggtctacagctcccagcgtgagcgacgcggaaaatgggtgatttctgcatttccatcggaggtaccgggttcatctcactagggagtgccagacagtgggcacaggtcagtgggtgtgcgcaccgt

SEQ ID NO: 14262 - DNA, 223 bp, Homo sapiens
cagtgggcatacagaggcagtcgggacccgtctggaagagcctccgcccggggtaaggagccgggactgtgtctaggaggcagtggggagctccggagagcgaagcgcctcctgcgcagactcgcgtgcttggagtaccggagcctgcagggcaagagagggtcttcagaagacccacgacgttccactgggatgcagagggaaacggttacttgtacttcta

SEQ ID NO: 14263 - DNA, 201 bp, Homo sapiens
cccaaagtactaggattacaagcagaaccaccgcgtctcttgttttcttttttgtttttgtttttgttttgttgttgttgttgatgttgttacagagtttcgctcttgtcgcccaggctgggatgcaatggtgtgatctcggctcattgcagcctccgcctcccggcttcaagcaattctcctgcctcagccttgtgagta

SEQ ID NO: 14264 - DNA, 203 bp, Homo sapiens
agtacaaataaattggtcgggcggtagtcccagctactcgggaggctgaggcagcagaatagcgtgaacccgggaggcggagcttgcagtgagccgagatcgcgccactgtactccagcctgggtgacagagtgagactacgtctcaaataaaaaaaaaaaaaaaaaaaaaaagcacttccctagacctagcttgatattagg

SEQ ID NO: 14265 - DNA, 201 bp, Homo sapiens
ccacgcccggctaatttttttgtattattagtagagacgaggtttcaccgaggtttcaccgtgttagccgggatggtctgggtctcctgacctcgtgatccgcccaactcggcctcccaaactgctgggattacaggcatgagacaccgcgcccggctgttgtctgatttttttcagcagtgttttgtagttctttttgta

SEQ ID NO: 14266 - DNA, 201 bp, Homo sapiens
ctcccgagtagctgggactacaggtgcctgccacctcgcccggctaattttttgtatttttagtagagatggggtttcaccgtgttagccaggatggtctcgatctcctgacctcgtgatccgccagcctcggccccccaaagtgctgggattacaggcgtgagccaccgcgcccggcccaatttaatttttaacaatggt

SEQ ID NO: 14267 - DNA, 201 bp, Homo sapiens
aaaagtcacagggggcgtgaggacagacggcgtgtcctttcctacacatatggagacgcaggccggagcaacggcacacggaccacgcacacgcggcggacgcaccaacgcctacgcagaagagaacaaaagtcgcttctaactgggcacaaaccctctgcacccaaatatcccgacacccacaaacaaaatcagaacaga

SEQ ID NO: 14268 - DNA, 201 bp, Homo sapiens
tgatctgccctcctcggcctcccaaagtgctgggattacaggcgtgagccaccgcgcccggcccaggtcactttttttttttttttttttttttttgaggcggagtctcgctctgtcgcccaggctggagtgcagtggcgcgatctcggctcactgcaagctccgccttccgggttcacatgattctcctgcctcagcctc

SEQ ID NO: 14269 - DNA, 201 bp, Homo sapiens
ggattacaggcgtgagccaccgcgcccggcctaaactatggatttttttttcccagtggagtttcgctcttgcccaggctggaataggatggcacgaactcggcttactgcaatctccacctcccgggttcaagcgattctcctgcctcagcctcccgagtagctgggattacaggcatgtgctaccatgcctggctagta

SEQ ID NO: 14270 - DNA, 201 bp, Homo sapiens
aattttttccccacccttcccgcctttctattccacaaaaccgccattgtcatcatggcccatccccaatgagctgctgggcacacctcccagacggggtcgtggccgggcagaggggctcctcacttcccagtaggggcggccgggcagaagcgcccctcacctcccggatggggcggctggccgggcggggggctgacc

SEQ ID NO: 14271 - DNA, 201 bp, Homo sapiens
gggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagt

SEQ ID NO: 14272 - DNA, 201 bp, Homo sapiens
tgggcagcagagtgagactctgtcttaaaaaaaaaaaaaaaaagggggggccgggtgcggtggctcacgcctgtaatcccagcactttgggagaccgaggcgggcagatcacgaggtcaggagatcgggaccatcccagctaaaacggtgaaaccccgtctctactaaaaatacaaaaaattagccgggcgtagtggcggg

SEQ ID NO: 14273 - DNA, 201 bp, Homo sapiens
gtgggagtcacagggtttcaggggaggagcgttccaggccgcggtaacagcaggtgcaaaggccctgaggcaggacggggcagggaggtccagagtccaccgcgcagagacccgggaggccggcaggcacggtgaggaccttgacttaaacccaggaaaggggaaccacactggggcatgacctcctgtactttccgagat

SEQ ID NO: 14274 - DNA, 201 bp, Homo sapiens
gggatttccccatgttggccaggctggtctcgaactcctgacctcaagtgatccacctgcctcggcctcccaaagtgatgggattataggcatgagccaccgcgcccggccaagggtcttttcagatgtaatcaagttaagatgaggtcatactgagttaggtgggccctaaatccaatggctagtgttcttataagcaca

SEQ ID NO: 14275 - DNA, 211 bp, Homo sapiens
gccctagggccggaggagcaggagacctgggcagcggggtgggcgagtgccgggaggaggtaagaggtcgcgggggaggaagacgctccccccggccttgcggggcaggtcgcgcagggcaggtcgtgcggggcaggtggggggtgccaaggaagtccgggcgtggccacaccgcagagaaagccatgggaggcacgtcctgagagctggg

SEQ ID NO: 14276 - DNA, 201 bp, Homo sapiens
gcagccaaagccatcttcttggttgaaagatactcttttcggggggaggagccaagatggccgagtaggaacagctccggtctacagctcccagcgtgagcgacaaagaagacgggtgatttctgcatttgcatctgaggtacccggttcatctcactagggagtgccagacagtgggcgcaggtcagtgggtgcgcgcac

SEQ ID NO: 14277 - DNA, 201 bp, Homo sapiens
gctcaggacctgcagcccaccatgcctgagcctcccacccactccatgggctcctgtgccgcccaagcctcccggacgagtgccaccccctgctccacggcgcccagtcccatcgaccacccaagggctgaggaatgtgagcacacggcgcaggactggcaggcagctccacctgcagccccggtgtgggatccactaggt

SEQ ID NO: 14278 - DNA, 201 bp, Homo sapiens
tggtaacattgtgaagacgtaggttctccatgggaaagactgttgtccggaagtttccacacaacaggtccccactgagattccaaggctgacagcacggcgggagtccctgggacccctgggcccggcacagcgccaccgcagcaggcaggcaccgggtggccagaagtcgatcattctcttaaatggcctgtacatatc

SEQ ID NO: 14279 - DNA, 201 bp, Homo sapiens
ctcccatgggctgacctggtgatcctccatggagaatgcgtaggagccggatattggcactgccaggtggaaaagtcccctgtcagggtgaaaagtcagacggcgtctgcctctcgctcttggagtgctcctggcctaacgcagcagtttcgcagataaacgttacagaaggtagagcgctctacagatatgaaggagtgg

SEQ ID NO: 14280 - DNA, 201 bp, Homo sapiens
gacttctggacccgctgggctgtttccgcacccggcttccctccctcaagcttgcggccgggtgtggctccctcaacctcagcgccgacctccgtgtctgcgcgctctctctctaccttcctcatccgcggggtcaggggtcacacggcaccgtcgcctgggtctccgagcagggagagtcgagtgctgactctgccagaa

SEQ ID NO: 14281 - DNA, 201 bp, Homo sapiens
ggacattttacaaaactcctgacgagtcctcctcaaaaccactaggttggccgggtgcggtggttcatgcctgtaatcccagcactttgggaggccgaggcgggcagatcacaaggtcaggagatcgagaccatcctggctaacacggtgaaaccccgtctctactaaacaatacaaaaaattagctgggcgtggcagcgg

SEQ ID NO: 14282 - DNA, 201 bp, Homo sapiens
cccctccccatccttccaggggcctgaccccttccccaaccgcacctttatagaatggtcggccagacaggaagtcccggctggcgaagcccagcccccgcgggcacaggctggcgaactccagagactcgggatccgggcaggcctcgcactcgactccccacacggccccgatggagcagcagcagacgtccatccggt

SEQ ID NO: 14283 - DNA, 201 bp, Homo sapiens
aaattagccaggcctggtggcaggcacctgtaatcccagctactccaggggttgaggcaggagaattgcctgaacccgggaggtggaggttgtagtgagccgagattgcgcctttgcactccagcctgggggacaagagtgagacttcgtctcaaaaaaaaaaaaaaaaaaaaaaaaaggccgggtggctcacacctgtaa

SEQ ID NO: 14284 - DNA, 201 bp, Homo sapiens
catcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgat

SEQ ID NO: 14285 - DNA, 201 bp, Homo sapiens
cccgcggggcccgtccgctcctccagccgctgcctcccgggcggcgctcgccggcgccgactcccataatttactttttctagacagagtctttctctgtcgcccaggctggagggaagtggcatgacctcagctcactgaaacctactccttccgggttcaagcgattctcacctctgcctttggagtagctgggactac

SEQ ID NO: 14286 - DNA, 201 bp, Homo sapiens
ccacctcagcctcctgagtagctgggaccacaggcttgtgccatcatgcccagctcattttttattttattttatttttatttttattttttttttgagacggagtctcgctctgtcgcccaggctggagtgcagtggcgggatctcggctcactgcaagctccgcctcccgggttcacgccattctcctgcctcagcctc

SEQ ID NO: 14287 - DNA, 201 bp, Homo sapiens
aaatggtgatttagaggccgcccccactcgacgggctttcttagccgaagacgttcagctaatgaacctcaagcagattcatggccgggtgtgaagtcaacggagtcctcactccgtggagacgagcagcataaatctttgtttttaatgtctaatgatatgtaaaatatttaaatttgcaacgcagaattattaagctgc

SEQ ID NO: 14288 - DNA, 201 bp, Homo sapiens
ggcaggcggattactttagcttaggagttcgagaccagcctgggtaacatggcaaaatcccatctctacaaaaaatacaaaaattagccggtcatggtgccgtgcacctgtagtcccagctactagggagactgaggtgggagggtcacttaagcctgggagaggcgggtgtggtggaggttgtagtgagccaagatgcac

SEQ ID NO: 14289 - DNA, 201 bp, Homo sapiens
tagattgacagattttttttttttttgagatggagtcttgcactgtcacccgggctggagtgcagtggtgcaatctcggctcaccgcaacctccccaacccgcgttcaagcaattctcctgcctcagcctcccgagtagctgggattacagggcgtgccaccacgcctggctaattttttgtatttttagtagagatgggg

SEQ ID NO: 14290 - DNA, 201 bp, Homo sapiens
cctcgggcggcaaggattccacggtgctggcacacgtgctgcgcacgctggcaccgggcctgggcatcttactgcagctcatggctgtagacaagggcatcgggcgtggcttagcgggaggatcccagtaaggagctggggaaatacgcatgtgcctatttagggccggagcctactgaaggctcatgtgggtagtacgtg

SEQ ID NO: 14291 - DNA, 201 bp, Homo sapiens
cggctcattgcaacttccaccttccgggttcaagcgattctcctgcctcagcctcctgagtagctaggattacaggcatgcaccaccacccccggctaatcgttgaattttcagtagagacggggtttcatcacgttcgcaaggctggtctcgaacccctgatctcaggtgatgcccccacgtcggccttccaaagtgcca

SEQ ID NO: 14292 - DNA, 201 bp, Homo sapiens
cggcctcccaaagtgttgagattacaggcgtgagccaccgcgcccggcccacctcaggtgatccacccctctcagcctcccaaagtgttgagattacaggcgtgagccaccacgccgggcccacctcaggtgatccacccccctcggcctcccaaagtgttgagattacaggcgtgagccaccgcgcccggcccacctcag

SEQ ID NO: 14293 - DNA, 201 bp, Homo sapiens
gacttgagaaccgtctgcatcagcctggcttcctgcacagtgtctgcgccggtgcacaccttagaggggagctgcgccatcagatgaaccaggaccctggcggaggaagggggtgccggcagggctcccatggcacctgctgcctgtggctgaggggagcctggaagggcaccagcctcacccacccctggccgagacccc

SEQ ID NO: 14294 - DNA, 201 bp, Homo sapiens
tccggcacactcagagcacactggggctggggtagatggtggcacctgtcttggctggaggagttgggagggctggggaagggacgtgtgatctcctctccgataaacctggacgagatgccaagtataacacagaggctggcggcggggcctcctcctgttcccggtggatcaactcattgtgggactttgggcaacttt

SEQ ID NO: 14295 - DNA, 201 bp, Homo sapiens
ttaaaaaacacacacggccgggcgcggtggctcacgcctgtaatcccagcactttgggaggccgaggtgggcggatcacgaggtcaggagatcgagaccacggtgaaaccccgtctctactaaaaaaatacaaaaaattagccgggcgcagtggcgggcgcctgtagtcccagctgctcgggaggctgaggcaggagaatg

SEQ ID NO: 14296 - DNA, 201 bp, Homo sapiens
acggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagaggtaagtcctgctgccacgtgc

SEQ ID NO: 14297 - DNA, 279 bp, Homo sapiens
gggcctgggctcgctaggtgtagaacaaggagaaaggggtagaggggaagagtcgggtcgaaccccagcgagggacccggccttccctggaggagaggatcgtactcgcgccaggagtatggactcacccagggagtgcttgggcggagaagcagcctctgctccaggccttccgctgcggcacctaaagaggccgggcggcccagaggcccgcaagccacgcccccttccaggccccgcctccgtttggccactccccttgctgtcagctcttccacc

SEQ ID NO: 14298 - DNA, 201 bp, Homo sapiens
ctggctgctatgaaatcataaattatgtttacagaaatttcagtctgagaaagaacctagattttcctttttttttttttttttttttgagactgagtctcgctctgtcgcccaggctggagtgcagtgatgccatctcggctcactgcgagctctgcctcccgggttcacgccattctctggcctcagcctcccgtgtag

SEQ ID NO: 14299 - DNA, 201 bp, Homo sapiens
tcgggggcggggcggggcggggcggggcggggcgggggggtggggctgaggcaggagaatggcgtgaacccgggaggcggagcttgcagttagccgagatcgtgccactgtactccaacccgggcgacagcgactctatctcaaaaaataataataataaaaaagaataaagattctataggcacttcttttacagcagag

SEQ ID NO: 14300 - DNA, 201 bp, Homo sapiens
ggggtctcaccgtgttagccaggatggtctcggtctcctgatgtcgtgatcctcccatctaggcctcccaaagtgctgggattataggcgtgagccaccgcgcccggcctagttcttcatttctaacaagttttcaggtgatgcttatgttggtagtcctctgagactatcacactttaagtttcagggtgttagaaaaac

SEQ ID NO: 14301 - DNA, 201 bp, Homo sapiens
tgttgttgttgtttttaagttggagtcttgttctgtcacccaggctgcagtgcagtggtacgatctcggctcactacaacctcggcctcccgggttccagcgattctcctgcctcagccacccaagtagctgggtctacaggcgcatgccactacgcctggctaatttttgtatttttaggagagacaggttttcaccatg

SEQ ID NO: 14302 - DNA, 201 bp, Homo sapiens
aaccgagctgtggaatggggttccgtggagcaggttgagtgtgccggtcgtggacgggtcgtgggcgggactccccagtgtgtcaccactgaggcatcttcgccctcttacgtgtctctgtttctctctctagaagtccaacacctccgagaggactcaaaacacagagtgaccagctcctatgtgcatttcctggacaaa

SEQ ID NO: 14303 - DNA, 201 bp, Homo sapiens
aggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcg

SEQ ID NO: 14304 - DNA, 201 bp, Homo sapiens
ccatacaccccacgcgccctgcccaccacgaggcctgtaccctctgggcagcaggtgccgcgcgcccccgggtaccttgtaggtggagccgtcggcgcagcgcagcaccccgtgtccctgacgccggtcccggacccagtcgccgtcgtacttgtcaccgttcctgggggacacacgcacggagtccactctcaacagggg

SEQ ID NO: 14305 - DNA, 201 bp, Homo sapiens
tctactacaaatacaaaaaattagccgggcgtggtggcgggcacctgtagtcccagctactcggaaggctgaggcaggaaaatgatgtgaacccgggaggcggagcttgcagtgagccgagatcgcgctgctgcacccaagcctgggcgacagagcgagactccgggtcaaaaaaaataaaagaatatagggtatggtatc

SEQ ID NO: 14306 - DNA, 201 bp, Homo sapiens
cagagtagctgggaccacaggcgcccactgccacgcccggcttatttttttttgtatttttagtagagacggggtttcaccgtgttagccaggatggtctcgatcttctgacgtgatccacccgcctcggcctcccaaagtgctgggattacaggcgtgagccaccgtgcccggcctattcatgtgctttctgggaagggg

SEQ ID NO: 14307 - DNA, 201 bp, Homo sapiens
aggcgcccgccaccacgcccggctaattttttgtatttttagtagagacggggtttcaccatgttagccaggatggtctcgatctcctgaccttgtgatccgcccacctcgtcctcctaaagtgctgggattacaggcgtgagccaccgtgcccggccgcctctcggcatacctcttattcctagcatgtggctctcacac

SEQ ID NO: 14308 - DNA, 203 bp, Homo sapiens
gttggtcatggaaggctacagtttcgcagatggtgtcggtggagtttggggcagggcattctgagcctgggaaggtttggggtgaaggcccggaggctggcgcgtaggaggctaaagcagcagggaggtctggggagagtcaggtggggttgtgtcttccacgttgcaggccgtgctcacagatggtgaaagacgttgtggaa

SEQ ID NO: 14309 - DNA, 201 bp, Homo sapiens
tcccaagtagctgggactacaggcgcccaccaccacgcccggctaatgtttttgtttttttagtagagacggggtttcaccgtgttagccaggatggtctcgatctcctgacctcgtgatcctcccgtctcggcctcccaaagtgctgggattacagcaatcactcgatggcgtgagccatcgcgcccggccatgtatgat

SEQ ID NO: 14310 - DNA, 201 bp, Homo sapiens
cctactctcgtgaaaactcttgtgcctgaaaattattgtaaaatatctggaattattattattatttatttttattttttgagacggagtctcgctctgtcgcccaggctggagtgcagtggcgcgatctcggctcactgcaagctccgcctcccgggttcacgccattctcctgcctcagcctcccgagtagctgggact

SEQ ID NO: 14311 - DNA, 201 bp, Homo sapiens
ttggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggaccccca

SEQ ID NO: 14312 - DNA, 201 bp, Homo sapiens
gtcactgatcctgagcttccgttttttcatctataaaactgagattagggccgggcatggtggctcactcctgtaatcccaacactttgggaggccgaggcgggcggatcacgaggtgaggagtttgagaccagcctgaccaacatggtgaaaccccgtctccactaaaaatacaaaaattagccgggcgtggtggcgcgt

SEQ ID NO: 14313 - DNA, 201 bp, Homo sapiens
gcatgttcattgcagaactattcacaacagcaaagacatggatagaccggattaagaaaatgtggtgtatatatatatatgccatggaatactatgcagtcgtaaaaagaacaaaatccggtcctttgcagcaacatggatgcagctggaggccattatccggagtgaattaacacaggaacagaaaaccaaatactgctt

SEQ ID NO: 14314 - DNA, 201 bp, Homo sapiens
ccccagttccgtgaccggccctctgctctgtgctgacacccagcaccctccccggcctctgctccgaggggaaaataaaacaggggccttcaggcctcaccgctggctcactccatcgcagcaaatcgaccgagggtcctctgctgcgtccttgcggcctgttgtcttactcagcggccctgacacccggcatttatttaa

SEQ ID NO: 14315 - DNA, 201 bp, Homo sapiens
gcgggcggatcacgaggtcagtagattgagaccattctggctaacatggtgaaacccagtctctactaaaaatacaaaaaattagccgggtgtggtggcacgcgactgtagtcctacctactggggaggctgaggcaggagaatcgcttgaacccgggaggcggaagttgcagtgagccgagatcgcgccactgcactccc

SEQ ID NO: 14316 - DNA, 201 bp, Homo sapiens
tctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaa

SEQ ID NO: 14317 - DNA, 201 bp, Homo sapiens
aaggcaggcggatcacggggtcaggagttcgagaccagcctggccaacttggtgaaaacccgtctctactaaagatacaaaaattagctgagtgttgtggcgcacgcctgtaatcccagctactggggaggctgaggcaagagaatcacttgcaaccgggaggcggaggatgcagtcagcgagatggcgccactgcattcc

SEQ ID NO: 14318 - DNA, 201 bp, Homo sapiens
actcagggggctgaggcaggagaatcgcttgaacccgggaggcggagtttgcagtgagccgagattgagccactgcacactccagcctgggcaacaagagcgagactcagtctcagaaaaaataaataaataataaaataaaaagcaggccgggtgcgatggttcacacctataacaccagcactttgggaggccgaggtg

SEQ ID NO: 14319 - DNA, 3238 bp, Homo sapiens
tagaacgccaggcgtgaaaggtgacgttgaggcagcacgagggaaaaagcagcaggcagcgatcgtcacacggacgacagtgccttcccggcagcccctgcgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgccaggcccgagggggttgttgtgtcccaggcttgcacccagggttccacggggggcaccccaaagcggcaagtaggttcccaggggaaggggacagcacgtcaggcttggagggggacgttgaggcagccccgggaataaagaggggatgctggggtcctgccacggataacactgtcttcccgacagcatctgtggtgggcctgggagcgtcatggagtccttggcttgcacccaaggtgcgtgtctcgccctcggggggcaccacaaagcggcaagaaggccaccgggggaagggtatgggacgccagggttgaaagggatagttgaggcagtccggggaaaaacgtggcaggctggggtcgtcccatggacgacagtgccttcccagcagcccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtggagtccctatcttgcacccagggtgcgtgtttcgcccatgggaggcaccccaaagcggcaagtaggcccctgggggaaggggacagcacctcagacttgaagggggactttgaggtagcccgtggaaaaaaacggcgacgctgagtttctcccacaaacgacagtgccttcctggcagccccttcgctgggccagggtggtcctggagtccgtggcttgcacccagggtgcgtgtctcgctcaagggggcaccccaaagcggcaagtagattcccgggggaagggagagcacgtcaggcttgaaggggaggttgaggcggccccggggtaaaagtggtgaagctggggtcctcccacggatgacaccgccttcctggcagcctctgcagtgggcccagaggtgtcgtggagtctctggcttgctcccaggttgtgtgtctcgcccacgagtggcaccacaaagcagcaagaaggcccccaggggaagggtacaggactccagggttgaaaggtagagttgaggcagaccggtgtcatcccaaggacaacagtgtcttgtccggtagcccctgcatcgggcctggggtggttgtggagtccctggcttgcacccggggtgcgtgtcgtgcccacgatgggcaccgcaatgcggtaagaagtccccgagtggaagggaacaggacgccgagcttgaaaggggacgttgaggcagtccggggaaaaaatttccactgagaacagtgccttcccggcagcctctgagtgggacccaggtggacggtggagcccctggcttggacccagggtgcctgtcttgctcacggggtgcacgtgaaagtggcaacagggcccccgggggaaggggacaacatgtcaggcttgaagagggacgttgggccagccagaggaaaacagcggctaggctgtggtcgtcccacagaccacagtgccttcccggcagcccctgagcctggcccaggcgggggggtttggagtccctgtcttgcaacagagtgcgtgtctcgcctaagtgtgcacgcgaaagctgcaagaagggctccgggggaagggaacaggatgccaggcttgaaaggggactttgaggcagtccagggaaaaactttccacggaggacagtgacttcccgacatcccctgcgcctggccctgggggtcttggagtccctggtttacacccagggtgcgtgcctcgcccacgggtggcaccccaaagcagcaagaaagccccggggggggaagaacaggatgccagacttgaaaggggacgttgaggcagcccaggaaaaaaaggggcgaggctggggtcctttcacggatgacagtgccttccctacagcccctatgccagtcccgggagggtcgcggagtccctgtcttgcacacaatgtgcgtgtctcgcccacggggggcaccccaaagtggcaagaagtcccccgcgggaaggcaacaggacgccaggcttgaatggggacgtttaggtagcctggagaaaaaagcagcgaggctggggtgatcccacgaatgacagtgccttaccggcagcccctttgccgggcatgcgggggttgttgattccctggcttgcacccagggtgagtgtcttgcccacggcgggcaccacaaagcagcaagaaggttcccgggggaaagggacagcacgtcagtcttgaagggggaagttgaggcagccccggggaaaaaaagcggggatgctggggtcctctcacggacgacactgccttcccagcagcctctgcagtgggcccgggagcgtcctggagtccctgtcttgcaccccgggtgcgtgtctcacccacggggagcaccacaaagcggcaagaaggccactgggggaagggtacaggacgccagggttgaaggggatagtggagacagtccaaggaaaaaagtggcgggatggtgtcgtcccaaggatggccacccctgcgccgggccagggatggtcgcggagtccctggcttgcacccaggttgtgtgtctcgcccacagggggcaccccaaagcagcacgaaggcctccaggggaagggaagaggacgccaggcttggaaggtgacgttgaggcagcagggggtaaaaagtggcgggccgggccctcccacggatgacagtgccttcccggaagccgctgcgcagggcccggcgtgtttgtggagtctctggcttgcacccagaatcgtgcggcgcccacgacgggcaccccaaagcggcaagatatcccccgctggaagggaacaggatgccaggcttgaaaggagaagttgagccagtccggggaaaaa

SEQ ID NO: 14320 - DNA, 201 bp, Homo sapiens
ccaaggctattacctcaaagtgtctcagaaaataatatacagaaggccgggcgcggtggctcacgcctgtaatcccagcactttgggaggccgaggggggcggatcacgaggtcaggagatcgagaccatcctggctaacacggtgaaaccccgtctctactaaaaacacacacacacaaaattagccgggcgaggtggca

SEQ ID NO: 14321 - DNA, 201 bp, Homo sapiens
ccaccatctattcattactctgcctgcaatttgggccatcactcattagtaatttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcg

SEQ ID NO: 14322 - DNA, 201 bp, Homo sapiens
acggtgattagaaatgcatcaaactctgaatgtacaaaagagagagcttcaatatgaaacagtaatcctctgagaacgaagaccccgcagtgccggtgcccgctgggccgtgcaggtctcggccgccccacgcccgtgtccgtctccaccgtgaccccctcgcccccggcacgcccagggtcaacccccgggcttattgca

SEQ ID NO: 14323 - DNA, 201 bp, Homo sapiens
cctggggatcattctgcctccttgctctgacttcttctttttttttttttttttttttgagacggagtctcgctctgtcgcccaggctggagtgcagtggcgcgatctcggctcactgcaagctccacctcccgggttcacaccattctcctgcctcagcctcccgagtagctgggattacaagtacccgccaccacgccc

SEQ ID NO: 14324 - DNA, 201 bp, Homo sapiens
cccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggcc

SEQ ID NO: 14325 - DNA, 201 bp, Homo sapiens
cggcgcccggcatgaaactttttttttttttttgagacagagtctcgctcttgcgcccaacctggagtgaagtggcacgattttggctcatggcaacctccgccccgcaggatcaagctattatcctgactcagcctcccgagcagttgggattacaggcacccaccactatggccggctaatttttgttttttgcttttt

SEQ ID NO: 14326 - DNA, 201 bp, Homo sapiens
aagcagcttcttaaaattttaaaaagtaagcatagctctaggaaggagggaggtcagtgaaatcaaactcctgtcgacaagcttaaagtaactggcaagacgctgggaaactagatactgaaacatccgctcttaacttttaacctgtcactatttgaaataaagttatcagggatagccgggcgcggtggctcacgcctg

SEQ ID NO: 14327 - DNA, 201 bp, Homo sapiens
atctattgaagaagctgaagtgtgaagtgtgaaattgaagaaccctgaaatgtattgagcagtgaaaagattatgtatacaaaaacaggttggccgggtgcggaggcaggcagatcacctgaggtcaggaggcgcgatctcggctcactgcaagctccacctcccgcgttcacgccattctcctgcctcagcctccggagt

SEQ ID NO: 14328 - DNA, 201 bp, Homo sapiens
attttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccctg

SEQ ID NO: 14329 - DNA, 201 bp, Homo sapiens
gtggcgcaatctcggctcactgcaagctccgcctcccaggttcatgccattctcctgcctcagcctcctgagcagctggtactacaggcgccgaccaccacgcccggctaattttttgtattttttgatagagacggggtttcatcgtgctacccaggatggtctcgatattctgaccttgtgatccgcctgcctcggcct

SEQ ID NO: 14330 - DNA, 201 bp, Homo sapiens
ggtgggcgggtcacgaggtcaggatatcgagaccatcctggctaacacggtgaaaccccgtctctactaaaaatacagaaaattagccgggcatgttggcgggcacctgtaagtcccagccactcgggaggctgaggcaggagaatggcgtgatcccgggaggcggagcttgcagtgagccgagatcacgccactgcactc

SEQ ID NO: 14331 - DNA, 208 bp, Homo sapiens
tttatttatttatttttgagacagagtctcgctctgtcgcccaggctggagtgcagtggtgtgatctcggctcactgcaagctccgcctcccgggttcacgccattcggcctcagtctcccgagtagctgggactacaggcgcccgccaccacgcccggctaattttttatatttttagtagagacagggtttcatcatgttagccag

SEQ ID NO: 14332 - DNA, 201 bp, Homo sapiens
tttctttcttttttttttttttttttgagacggagtctggctctgttgcccaggctggcgtgcagtggctcactgcaccctccgcctcccgggttcaagcgattctcctacctcagcctcccaagtagctggggctaaaggcctgtgccactatgcccggctaattttttgtactttagtagagacggggtttcaccgtgt

SEQ ID NO: 14333 - DNA, 201 bp, Homo sapiens
ccgtggtgcaatctcagctcattgcaacctctgccggcagggttcaagcaattctcctgcctcagtctcccgagtagctgggattacaggcacgcaccacgatgcccggttaatttttgtatttttagtagagatggggtttcaccatgttgaccaggctggtcttgaactcctgacctcaggtgattcgcccacctcggc

SEQ ID NO: 14334 - DNA, 201 bp, Homo sapiens
gtgggtttcaaacatcttacaagctagagtaatcagaacagtatggtactggtataaagacaggtacacagcccgtccggtcccgtcccgtcctgccgccgcgcctgtcagccatgagctccatgcagttaaacaaaggcccctctgtggactcttggctgaggttaagaaccggctcctgtccaaatatgacctccagaa

SEQ ID NO: 14335 - DNA, 201 bp, Homo sapiens
cattgacctggaagaacggaatgatagttagtgaggcacactcagcaaccgagcacggccagtgccggtccccggctcccgagacactgacccacgcagcgccaggatccggggaccctctaggtgcaaatcagaggccaaacagcctgcctggccaatgggtcagaatctgtggttgaacagaggctttgttgtggtttt

SEQ ID NO: 14336 - DNA, 201 bp, Homo sapiens
ctattcttgggggatgagaggagggatggtgagaggacactcttaaagaacatttggggccggggaagaatccttcatgatctcgccctataacctggccgctcatcttgcattctgctgcacgctgcccggcctttggccatgttatgtgaactcctggagccatccttctttcttctttacctggatggagagggcctc

SEQ ID NO: 14337 - DNA, 201 bp, Homo sapiens
tttaacagatatgaaaactgaaggccgggcgcagtggctcaagcctgtaatcccagcactttgggaggccgaggcgggcggatcacgaggtcaggagatcgagaccatcctggctaacacagtgaaaccccgtctctactaaaaatattaaaaattagccgggcgtggtggcgggcgcctgtagtcccagctacttgggag

SEQ ID NO: 14338 - DNA, 201 bp, Homo sapiens
ctgaatagctgggactacaggcgcctgccaccgcgcccggctcattttttgtgtgtttttagtagagacggggtttcaccgtgttagccaggatggtctcgatctcctgacctcgtgatccgcccgcctcggcctcccaaagtgctgggattacaggcttgagccaccgcgcccggctaaaacaactaatttttgtgttaa

SEQ ID NO: 14339 - DNA, 201 bp, Homo sapiens
acggacccttgcggtgagtgttacagttcttaaaggtggcgtgtccggagtttgttccttctgatgttcggatgtgttcggagtttcttctggtgggttcgtggtcttgccggctcaggagtgaacctgcagacctttgcggtgagtgttacagctcataaaggcagtgtggacccatagagtgaacagcagcaagattta

SEQ ID NO: 14340 - DNA, 201 bp, Homo sapiens
tattaaaaataaagaaggaggccgggcgcggtggctcacgcctgtaatcccagcactttgggaggccgaggtgggcggcggatcacgaggtcaggagatcgagaccacggtgaaaccccgtttctattaaaaatacaaaaaattagccgggcgcggtggcgggcgcctgtagtcccagctactgggaaggctgaggcagga

SEQ ID NO: 14341 - DNA, 201 bp, Homo sapiens
gtcaagacagcgccattgcactccagcctgggaatagagcgagactccgtctcaaaaaaaaactattgatatacataaatacctgtgaaaccggctgggcgcggtggctcacgcctgtaatcccagcattttggggggccgaggcgggcgtattacaaggtcaggagatcgagaccatcctggctaacacggtgaaacccc

SEQ ID NO: 14342 - DNA, 235 bp, Homo sapiens
gtctacagctcccagagagagcgacgcagaagatgggtgatttctgcatttccatctgaggtaccgggttcatctcactagggagtgccagacagtgggcgcaggtcagtgggtgcgcgcaccctgcgtgagccgaagcagggcgaggcattgcctcactccggaagcacaaggggtcagggagttccctttcctagtcaaagaaaggggtgacagacggcacctggaaaattgg

SEQ ID NO: 14343 - DNA, 201 bp, Homo sapiens
ccccgagtagctggcgctacaggcgcccaccaccacgctcggctaattttttgtatttttagtagagacagggtttcaccatgttagccaggatggtctcgatctcctgacttcgtgatccgttcgccttggcctcccaaagtgctgggattacaggcatgagtcaccgcggccggccctaatcatgtatctttatctacc

SEQ ID NO: 14344 - DNA, 201 bp, Homo sapiens
ctgattatccaggtgcgtctgtcacccctttttttgactcggaaagggaactccctgtccccttgcgcttcccaagtgaggcaatgcctcgccctgcttcggcttgcgcatggtgcacgcacccactgacccgcgcccactgtctggcactccctagtgagatgaacccggtacctcagatggaaatgcagaaatcacctg

SEQ ID NO: 14345 - DNA, 201 bp, Homo sapiens
tgggccgctgggtgcccgggctgtcctcctactgcccaggacaaactccacctcgtcccaccggtcgatggcctgccggggagcccgcgggcgagccggcgtctgtaggtgtgttcttctgctgacatgctctccgtgaccagccgcttctgtcttcttccactgatgcgttcctctcgccctccagcagcttctgtctct

SEQ ID NO: 14346 - DNA, 201 bp, Homo sapiens
cacctggctcggagggtcctatgcccaccgagtcttgctgattgctagcacagcagtctgagatcaaactgcaaggcagcagcgaggctgggggaggggcgcccgccattgcccaggctcgcttaggtaaacaaagcagccgggaagctcgaactgggtggagcccaccacagctcaaggaggcctgcctgcctctgtagg

SEQ ID NO: 14347 - DNA, 201 bp, Homo sapiens
ccgccttgcagtttgatcttagactgctgtgctagcaatcagcgagactctgtgggcgtaggaccctctgagccaggtgccggatataatctccaggtgcgccgttttttaagcccgtcggaaaagcgcagtattctggtgggagtgacccgattttccaggtgccttctgtcacccctttctttgactaggaaagggaac

SEQ ID NO: 14348 - DNA, 201 bp, Homo sapiens
agcgacgcagaagacgggtgatttctgcatttccatctgaggtaccgggttcatctcactaagggagtgccagacagtgggcgcaggccagtgggtgcgcgcaccgtgcgcgagccgaagcagggcgaggcattgcctcacctgggaagcacaaggggtcagggagttccctttccgagtcaaagaaaggggtgacggacg

SEQ ID NO: 14349 - DNA, 201 bp, Homo sapiens
catcaggacaccctggctgcagagaggagctacccaccgcgagtctcctctgagctgttctattactcagtaaagctcctcttcaccttgctcaccctccgcttgtccacgtacgtcattgttcccgggcgctgaacctgccaaatggtggaggtgaaagagctctaacacaaacagagctgaaacacgccccttgcttgc

SEQ ID NO: 14350 - DNA, 201 bp, Homo sapiens
gctggagtgcaatggcatgatcttggctcactgcaacatctgcctcccgggatccagcaattctcctgcctcagcctcccgagtagctgagattacaggcgaccaccaccacgcccggctgatatttgtatttttagtagagacggggtttcaccatgttggccaggctggtctcgaactcctgacctcaggtgatctgcc

SEQ ID NO: 14351 - DNA, 201 bp, Homo sapiens
cactgttggcactagcatctggaagaggggaacaccgtggctcctgaaaacttggagccgccagcaactgaggagtcccaaggagtgagacgggggtgtcgttctaccactctctcattcctgcagccggcagctttgttagcggtgggggccgggttgaggggtggtggtatactaggggggtggtggtatatactacag

SEQ ID NO: 14352 - DNA, 201 bp, Homo sapiens
gtcttccggcactaccagtatctgggccctctggagcggaagtggctggccggggatatgcagctcacagaggtccagatgaaaacctggtttcaaaaccgccagatgaaacacgaacggcaaatgcaggattcacagctgaacagccccttcttggggtctctccacgcgcccgggctttccactcaccgtcttctggcc

SEQ ID NO: 14353 - DNA, 207 bp, Homo sapiens
accagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagc

SEQ ID NO: 14354 - DNA, 201 bp, Homo sapiens
acatcaggggaagaagacacaagcgctggtcatccataggagcaccccagcagaaggacacgctgacaggcacccggaagccagtaggccgtggaccagcgggaggaggcggaggttggcctgggcagtcaggggagagccggggctgccgagcaccccaactccaggggaaaaccatctcccttctggctgccccatggg

SEQ ID NO: 14355 - DNA, 201 bp, Homo sapiens
ccgattttccaggtgcgtccgtcacccctttctttgactcggaaagggaactccctgaccccttgcgcttcccaagtgaggcagtgcctcgccctgcttcgcgcacggtgcacgcacccactgacctgcgcccactgtctggcactccctagtgagatgaaaccggtacctcagatggaaatgcagaaatcacccgtcttc

SEQ ID NO: 14356 - DNA, 201 bp, Homo sapiens
ccacgccccaggcacaccgacatctccgcactggttccctccaggaggccacgccccaggcacacgggcatctccacactgactccctctagtaggccacgccccaggcacacgggcatctccacactgactccctccgggaggccacgccccaggcacacgggcatctccacactggttccctccaggaggccacgcccc

SEQ ID NO: 14357 - DNA, 201 bp, Homo sapiens
gcccctctgcccggccgcccagtctgggaagtgaggagcgcctcttcctggccgtcatcccgtctaggaagtgaggagcgtctctgcccggccacccatcgtctgggatgtggggagcacctctgccaggccgcgaccccatctgggaactgaggagtgtctctgccccgccaccaccccatctgggaggtgaggagcgtc

SEQ ID NO: 14358 - DNA, 201 bp, Homo sapiens
gagggagacgcggggcgggaactggggctgctcgcggtaggccagagcaagttctgggtggacatggccttggcgggccccacactccgagcagctggccgccccaccagccccgggcagtgaggggcttaccacccgggacagcagctgtggagggtgcgccgagtcccccagcagtgccagcccgccggcgctgtgctc

SEQ ID NO: 14359 - DNA, 201 bp, Homo sapiens
tctgattaaaaataaataaatatggccgggtgcggtggctcaggcctgtaatcccagcatttcgggaggccgaggcggtggatcacaacgtcaggagatcgagaccatcctggctaacacggtgaaaccccatctctactgaaaatacaaaaaattagccgggcgtggtggtgggcacctgtagccccagctactcaggag

SEQ ID NO: 14360 - DNA, 201 bp, Homo sapiens
cggccagggggcacccctagacgcacagaagcttcggaggccatggcaagtctgcaaccgggacccgcctctaggctcacacgtgtagctttccagctgcgcaatctccttaaatggagcagctccggcgtgggtggggcccgggccggcagtgggggcggggccggcagtgggggcggggccagtcgggggaggaggggg

SEQ ID NO: 14361 - DNA, 201 bp, Homo sapiens
tatggcgaaaccccatctctactaaaaatacaaaaattagttgggcgtggtagtgcacgtctgtaattccagctacttgggaggctgaggcaggattatcgcttgaacccggaaggtggaggttgcagtgaaccaagagagcggttctgcactacagcctgaacgacagagcaagactccatctcaaaataactaactaac

SEQ ID NO: 14362 - DNA, 201 bp, Homo sapiens
atcacgcccggctaattttttttttttgtatttttagtagagacggggtttcaccgtgttagccaggatggtctcgatctcctgacctcataatccgcccgcctcggcctcccaaagtgctgggatgacaggtgggagccaccgcgcccggcccaattcagcgttcgatatttgaagacgatctgggtcagaggagaccgc

SEQ ID NO: 14363 - DNA, 201 bp, Homo sapiens
agcgagccgccgatgccagcgagatgccaggctggactcagcaagccgccgatgccagccagacgcagagcagagaacgctggtcaaagagcagctaggcggtgtctgctcggccgaagcccagtcccggagaggcaggctctgtaccaggacgtggaggctccggggtcatgaaacccccagggtgagagacaaaggtag

SEQ ID NO: 14364 - DNA, 380 bp, Homo sapiens
tttttttttttttttttagacggagtctagctctgtctccatgctgcagggcagtggcgcggtctcggctcactgcaacctccgcctcccgggttcccgcgattctcctgcctcagtctcccgagtagctgggactacaggcacacgccaccacgcccagctaatttttgtttgtttgtttatttatttattattatttttgagacggagtctcgctctgtcatcaggctggagtgccattggagtgcaatggcacgatctcggctcactgcaatctccgcctcccgggttcaagcaattcccctgcttcagcctcccgtgtaactgggactacaggcacgtgccaccacccccagccaattttttgtattttagtagag

SEQ ID NO: 14365 - DNA, 201 bp, Homo sapiens
gagtgcaatggcgcgatctcggctcactgcaagctccgcctcccgggttcacgccattctcctgcctcagcctcccaagtagctgggactagaggtgcccgccgccacgcccagctaattttttgtatttttagtagagacggggtttcaccgtattagccaggatggtctcgatctcctgacctcgtgatccgcccgcct

SEQ ID NO: 14366 - DNA, 201 bp, Homo sapiens
cacagggtgtcgaaatcaagccacccagggagcccgcagatcccaccctctccggtgagagagtttggtggggagcacttcatccaatgcagggaacagcgttactgcggccttcacctcccggcttcaagtgattcacctgccgcagcctcccaagtagttgggattacaggcgcgtgccaccacgccgggctagttttt

SEQ ID NO: 14367 - DNA, 201 bp, Homo sapiens
ttcctcccttgggggctccctcatgcctcatgcagctcatggtgtggggttcattggccctggcggggtggaaggtcccatgccgtcgtcgtctcacgtcgtcggtggtgggggcttgttgggggttgggaggaaggcaaataggaagggtccaccggggagagggtgggggagcacgtcacagtcgccgcagttcgccgt

SEQ ID NO: 14368 - DNA, 201 bp, Homo sapiens
tccaggtgcgtccgtcacccctttgactcggaaagggaactccctgaccccttgcgcttcccaagtgaggcaatgcctcaccctgcttcggctcacgcacggtgtgcgcacccactgacctgtgcccactgtctggcactccctagtgagatgaacccggtacctcagatggaaatgcagaaatcacccgtcttctgcgtc

SEQ ID NO: 14369 - DNA, 201 bp, Homo sapiens
ggctgtagtgcagtggcgcgatctccgcttactgcaagctcctcctcccgggttcacgccattctcctgcctcagtctctgagtagctgagactacaggcgcccgccaccacacccggctaattttttgtaaaaaatttaaaaaaaaaattaaagataaaatgggttcggcagtatgatactctttatccctaattatttg

SEQ ID NO: 14370 - DNA, 201 bp, Homo sapiens
ttctgttttccctaagcgtcggccaggttgagaaataaagggacagagtacaaaagagggaaattttaaagccgggcatccgggggagacatcacatgtcggtaggttctgtgatgcccctgagccgtaaaaccagcaagtttttattagggattttcaaaaggggagggagtgtacgaatagggtgtgggtcacagagat

SEQ ID NO: 14371 - DNA, 201 bp, Homo sapiens
agcagtgcccctacaaacaggcgtgaaaaccgagcatgtcttgggctggtcagctgaatcattgcgtgtagagagggagtcctggccgcacaggcacagcggcggattatgtttctacatatgtcgcctgtatagaaaatggagaataagctcctccctgggccgggtttttaagattataacaataagagttcgccaaag

SEQ ID NO: 14372 - DNA, 201 bp, Homo sapiens
ccccaggggcctcaaaccggagccttatctccaggacccacaaaactctagacacagccaggacctgccagggagaccagcctcctccggcagcctgggcgctgctgtttccaacacacagtgataacccggaacccatcctcagagttactcagaaacacgctctggagatggtgccttccgaaagacctctactcccaa

SEQ ID NO: 14373 - DNA, 201 bp, Homo sapiens
ggatgtctggttatatctgatttctcacctctgggtatggaggtctgtctgcagaggcccgggcccgggcacaaagggagagagaggcctccattgtcccgcaggggccgaaatgcagaccgtgcatccccggtgacctcggggacccttctctgatcatcaggattctcttggactctagggtccttgtcctgctcaggc

SEQ ID NO: 14374 - DNA, 201 bp, Homo sapiens
ttagtagagacggggtttcaccgtgttagccaggatggtctcgatctcctgacctcgtgatccgcccgtctcggcctcccaaagtgctgggattacaggcgtgagccaccgcgcccggccacctattttttttaagagatggttgatatgatttcaatcttcttaaatttctgaagacttgttttgtgacctagcatgtga

SEQ ID NO: 14375 - DNA, 568 bp, Homo sapiens
aggtggagctgcctgccagtccggcgccgtgtgcccgcactcctcagcccttgggcagtcgatgggactgggcgccgtggaacaggggttggcgctcgtcggggaggcttgggctgcacaggagcgcacggcgggggtggaggctcaggcatggagggctgcaggtcccgagccctgcccggcggggaggcagctaaggcccagcgagaagtcgagcacagcagctgctggcccaggtgctaagctcctcactgcccgggccggctggccgctccgagtgcggggcttgccaagcccacgcccacccggaactcgagctggcccgcaagcgcagcctgcagccacggttcccgcccacgcctctctctccacacctacccgcaagctgagggagccggctccagccttgtccagcccagaaaggggctcccacagtgcagcgacgggctgaagggctcctcaaacgcggccagagtgggcgccaaggccgaggaggtgccgagagggagcgagggctgtgagggctgccagcacgctgtcacctctcatttttgtgtctgtatactaa

SEQ ID NO: 14376 - DNA, 201 bp, Homo sapiens
tcttttcttttctttcttttttttctttttttgagacggactcgtgctctgtcgcccaggctggagtgcagcggcgcgatctccgctcactgcaagctccgcctcccgggttcacgccattctcctgcctcagcctcccgagtagctgggactacaggcacccaccatgatgcccagctaattttttgtatttttagtaga

SEQ ID NO: 14377 - DNA, 201 bp, Homo sapiens
atcccagagaagcccatgggagccccagggagagttttctttgtgaagggcagggcaccctggaatgggtttgccgagcccgctcccacccggaactcacgcttgcccacaagcgccccacacagccctggttcccacctgcgcctctccctccacacctccccgcaagcagagggagccaactccggccttggccagccc

SEQ ID NO: 14378 - DNA, 201 bp, Homo sapiens
ggataaagaaaatgtggtatatggctgggcacggtggctcacgcctgtaatcccggcactttgagaggccaaggcgggcagatcacgaggtcaggagatcgagaccatcctggttaacacgatgaaaccccatctgtactaaaaaatacaaaaaattagccaggcatggtggcgggtgcctgtagtcccagctacttggga

SEQ ID NO: 14379 - DNA, 201 bp, Homo sapiens
ctgcactccagcctgggggacagagtgagactccgtctcaaaaaagaaagaaaaaaatgcccctccctccctgttccccctgactcctactctgtcttgcgggctcttcactaacaaccgcccgtgtttgacccgggtgcccctcccatcacaaccttccccccaggtgcatgtccccataacaaagttcaccccatggtt

SEQ ID NO: 14380 - DNA, 201 bp, Homo sapiens
ctagccccatccatgcgccactcatggataagggtaatcaccagcagcagtgattatgtgtgtcaggcactcgtaggtcccttcccgttctctgaaccacgtgctacgcccagctcagggatgataaactgaggtgcacgagtaggtgagaagacgaacagtgtacccgggcaaggccgccagcccttttgtgctcctgtg

SEQ ID NO: 14381 - DNA, 201 bp, Homo sapiens
ccatcattgatatccacccttcctccacctacagcatccgcatgtacgccaagaaccggattggcaagagcgagcccagcaacgagctcaccatcacggcggacgaggcaggtacgtgggaccgggcggaaccttgctccagaggagcccgggagctaactcttgagggctcagatgcttaaatgcagaagcagacctttg

SEQ ID NO: 14382 - DNA, 201 bp, Homo sapiens
gcgggaggcgcgcaagtgacacactgaggggcccaggcagcagcccccatacgctgccaggtcagagcagccccgggccacgtgggtgcccccagctgccgctgtaggcggaggtacgccggttcctcaaggatgtgacagcggctggactttcatgaccactgcttggccaccagagggcaagtcccagggccagccaag

SEQ ID NO: 14383 - DNA, 201 bp, Homo sapiens
gggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgag

SEQ ID NO: 14384 - DNA, 201 bp, Homo sapiens
taacattgtttgcaaatgattgaaccggcctctgaccctctcagagaagatcgtgtacagacacccggatgaccccaccagccaggaaattgagcggggcgggacgtacctgcagcagtggccggacagcgtgaccatgcaggatggacggcccagatggccatgctgcagttcatcagcagcaggctcccaaggtgacca

SEQ ID NO: 14385 - DNA, 201 bp, Homo sapiens
ccggacagtaaacacgcgtgggtctcccctgtgccggacagtaaacacgcgtgggtctccctgtgccaaacggtaaacacgcgtgggtctctcgtgtgccgaacagtaaacacgcgtgggtctcccctgtgcccgacagtaaacacgcgtgggtctcccgtgtgccggatgataaacacgcatgggtgtcctgtgtgctgg

SEQ ID NO: 14386 - DNA, 201 bp, Homo sapiens
gtttcaccatgttggctaggctggtctctctaactcctgacctcgtgatccacccacctcggcctcccaaagtgctgggattacaggagtgagccactgcgcccggccgagattcttatgctattattctatgaagcccttggcacaatgcttgacacacagtaggtacctgataagtggagcttctattgctgttcccct

SEQ ID NO: 14387 - DNA, 201 bp, Homo sapiens
gagccaggtgtgggatatagtctcgtggtgcgccgttttttaagcccgccggaaaagcgcagtattcgggtgggagtgacccgattttccaggtgcgtccgtcacccctttctttgactaggaatgggaactccctgacccctcgtgcttcccgagtgaggcaatgcctcgccctgcttcggctcgcgcacggtgcgtgca

SEQ ID NO: 14388 - DNA, 201 bp, Homo sapiens
tcctttggagccaactgtgctttcattactttaaatagagcagtcgggaccgggcgctgtgcctcacgcctataatcccagcactttgcgaggccgaggcgggcagatcacgaggtcaggagatcgagaccatcctggctaacatggtgaaaacctgtctccactaaaaatacaaaaaattctccgggcgtggtggcgggc

SEQ ID NO: 14389 - DNA, 201 bp, Homo sapiens
ccgacagagtgaaatggcggcggcggccgggatgatgctgctgggcttgctacaggcgggtgggtaggtgctgggccaggcgatggaggaggtggcaggcggcaacctcttgtccatgctgctgatcgcctgcgccttcaccctcagcctggtctacttgttccgtctcgctgccggccacctggtccagctgaccgcagg

SEQ ID NO: 14390 - DNA, 201 bp, Homo sapiens
gtgaaaccctgtctctactaaaaataccaaaaaaattagccggcgcggtggcaggcgcctgtagtcccagctactcgcaaagctgaggcaggagaatggcgtgaacccgggaggcggagcttgcagtgagctgagatcgcgcctccgcactctagcctgggtgacagagcgagactctgtctcaaaaaaaaagcagtctgg

SEQ ID NO: 14391 - DNA, 201 bp, Homo sapiens
tttttatttttgtttttgagatggagtctcactcttatccaggctggagtgcagtagcatgatctgggctcactgcaatctctgcctcccgggttcagtcgattctcttgcctcagcctcccaagtggctggaattacaggcacacaccaccacacccggcaaatttttttttttttttttttgtatttttagtagactgt

SEQ ID NO: 14392 - DNA, 201 bp, Homo sapiens
catggtgaaactccgactctgctaaaaacacaaaaattagccgggcgtggttgtgagcacctgcaatcccagctacttgggaggctgaggcaggagaatcgctagaacccgggaggtggaggttgcagtgagccaagatggcaccactgcactccagcctgggcaatagagtgagactccatctcaaaacaaaaaaaaaca

SEQ ID NO: 14393 - DNA, 201 bp, Homo sapiens
acctgctttaaggactggaagaggaaaatcaaaaataccatttgaaaggccggacgcggtggctcacacttgtaatcctagcactttgggaggccaaggcgggcggatcacgaggtcaggagttcgagaccagcctggccaacacaatgaaaccccgtctctactaaaaatacaaaaattagctgggcttggtggcaggca

SEQ ID NO: 14394 - DNA, 201 bp, Homo sapiens
tgcagtggcacaacctctgctcctgcaacctccccctcccggcttcaagcgattctcgcgcctcagctcccaagtagctgggattacaggctcgagccccgcccggctaattttttccatatttttagtagagatggggtttcaccatgttggccaggctggtctcgaactcctgacctcaagtgatccgcccaccttggc

SEQ ID NO: 14395 - DNA, 201 bp, Homo sapiens
aacacgggtggctccgcgcaggacgggggccccagggccgcttgagccggaggacagcccgcagtctccaccgtctgcagttgaagtgtgttgtgagatcgctgcaggggcccgggccacctctgccttgggggaccctaaaaagctgagccacacccatgttgaaacttccactgaggataatcacgcaccatacagacc

SEQ ID NO: 14396 - DNA, 201 bp, Homo sapiens
agcctccgctgaccccagcacgagccgctcatacacattcaaggccggcagcacagcggcatatgtggcaaaaccgagcaggcgtggatgggaagggagcgcatcagcctgcgtgtgaaggccacatctaggggcggagggaggggagaaacacctctgccgtatctgcagtgtttcacttctctcagtaacccaaaacgc

SEQ ID NO: 14397 - DNA, 234 bp, Homo sapiens
ccctgctgacgcagtgcccgccgccgttcctggatgacttcagtggtgaagtggtgcaccatgtcacaggcctgccggaacctccgcccatccgccgagcggtagtaaatgaagtcgaggtagtggtgcaagcgatactggcgccggacagacagagcgctcagttcaatgatagcggagatataatcactcatcttcctgccaaggagaaggggatccatgagtgtagcccct

SEQ ID NO: 14398 - DNA, 201 bp, Homo sapiens
cagctttctcatctgtgcagtgggcgcaatgtcgatgactgcctccgggaagtcagacggtgtctgggaggcgctgagctggggctgacacagagcgagcgctccgtgaagtacctgggtcctgtgatgtttccaagtctacagacgcatcacgccatgaggaacacacctgggctggcgatgctggagacaagggacccc

SEQ ID NO: 14399 - DNA, 201 bp, Homo sapiens
cagtgagcacagaccgcgccactgcactgcagcctgggtgacagaagtgaaaagaaacactgtctcaaaaaaaaaacaggagggaggagccaagatggccgaataggaacagctccggtctacagctcccagcgtgagcgacgcagaagacgggtgatttctgcatttccatctgaggtaccgggttcatctcactaggga

SEQ ID NO: 14400 - DNA, 201 bp, Homo sapiens
gatgaaaccccgtctctactaaaaatacaaaaatttagccgggcgtggtggcggacgcctgtagtcccagttattcaggaggctgaggcaggcgaatggcgtgaacccgggaggcggagcttgcagtgagccgagattgcgccactgcactccagcctgggcgacagagcgagactctgtctcaaaaacaaaataaaatta

SEQ ID NO: 14401 - DNA, 201 bp, Homo sapiens
gtgagtgtggggtccagctggctgttccaagcaccggtacacaggcaggttctaggcagggcttgcagctggaccaggcatgtcaccccgaagggaatgcggtggcaccccaagaggggtgctcagaccttgaagccccggaaggggcgattctacttgctaattagctcttttagttctgccatccgcagccctagggat

SEQ ID NO: 14402 - DNA, 201 bp, Homo sapiens
gtgcggctccttagccagggcagctcgaaatccaggaacgctccaaggtcatcctgtgggaactgtggcgccagggcccctgaacaccctcctgtcctccgagtcgagtcgctccatctgcctcctaaacgggcttcgggaggaaggcccgcgtgtctcctcaaggtgaggagctactgatgtaaactccctgcaaggacc

SEQ ID NO: 14403 - DNA, 201 bp, Homo sapiens
ggggacccagctcacgtgtgtgggggccgtgcgtgtccgtttcgcctgttcatgtatgtcacacatgtgagagtccacagcgagggcagcctttacacgcgatggcccagaggagcgagcatctcaggctcctcagcacgtctctgtgctgacctcctgcagcactgccgggagccatgtgagtgtccacgcctgtgtgtg

SEQ ID NO: 14404 - DNA, 201 bp, Homo sapiens
tccatccgcctttcgtctccctccctgctggatctgaggcgccgctcccgccgcgctgtcctcgcgccatgccacgtcacgtcacgtcacgtcacgttacgttcccacgtcacgtccacgtcacgttcccacttcccgtccacagggaaacgggccccggcgatgtgagggcgtctgccgtgcttggtgccttcacagggg

SEQ ID NO: 14405 - DNA, 201 bp, Homo sapiens
agttcttaaagcctcaactccttcttttttttttttttttctttttttttttttttgagccggagtctcactctgttgccaggctggagtgcagtggcgcgatctcagctcactgcaacctctgcgtcccgggttcaagggattctcctgcctcagcctcctgagtagctgagactgcaggcacgtgccaccacgcccagc

SEQ ID NO: 14406 - DNA, 201 bp, Homo sapiens
ttgtaggacagccctaaaaaggaaggctatcttttttctgtctaccaccgtagtttgctaaccaatcagaaggcaggcgctgagacagtaacaaccagccgacagttgcggaggactgccgggactcccacagagctcgacaagtgggatcacagtcatcaccagccactgagaagagtgtcccctacccacagagtgcaa

SEQ ID NO: 14407 - DNA, 201 bp, Homo sapiens
tcaaactcccagagggcttactgtaagattctccccgggcctgaaagcttaagatgaataactcctcccttttcaggcccagtcccaaggcgcaacttgcgccagcagggtgcgccagcagggtgcgccagcagggtgcgccagcagggtgcgccagcagggtgcgccagcagggtgcgccagcagggtgcgccagcaggg

SEQ ID NO: 14408 - DNA, 686 bp, Homo sapiens
atcatgcctcagccttcctggccgctctcacctccaaacacccgaaaaacagaggcgctgggtgcgaggcggagagatgcacaggtctggtcccggccccgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgtgagttttgctctgccttgtattaagtctgcacttcccaggtccctggcacttctgtccctgggacgtggggtcctcacagacctggaaattcttgcctgtcttccttcacccagagcaaattgagacgcccataagagtctggaagttgcttccttttgggtttgaagtcgcttggaggctggtcccgtccccggtctttctgctatagggcaatgtatacacttcctatcgcatagttttcctgctcaaaaccttgttgactcatcctgccccttgctttttaaagtcctcacccgtgcgctggattcccgccctgggcgcctcccagcccccgtcggcctcccctggagcgcagcgccggggccccagtcctggggaggctgggtcctctgcctggtcctgggagcctgcaggtgccac

SEQ ID NO: 14409 - DNA, 201 bp, Homo sapiens
aggctggcagatcacgaggtcaggagatcgagaccgtcctggctaatatggtgaaaccccgtctctactaaaaatacaaaaactagccgggcgtggcggcgtgcccctgtcccagctgctggggaggctgaggcaggagaatggcgtgaacccgggaggcggagcttgcagtgagccgagatcgcaccactgcactctagc

SEQ ID NO: 14410 - DNA, 201 bp, Homo sapiens
cactgcaagctccgccttccgggttcacgccgttctgctgatctcgtgatccgccccgcctcggcctcccaaagtgctgggattacaggcgtgagccaccgcgcccggccaacagttttcaatattaattattcagagtgtgtaataacttggaaaagggctttttttttcttttttgcttttagagacagggtctctggc

SEQ ID NO: 14411 - DNA, 201 bp, Homo sapiens
tgggagtgacccgattttcaaggtgcgtccgtcacccctttctttgactcagaaagggaactccctgaccccttgcgcttcccaagtgaggcagtgcctcgccctgcttcggctcgcacacggtgcacgcacccactgacctgcgcccactgtctggcactccctagtgagatgaacccggtacctcagatggaaatgcag

SEQ ID NO: 14412 - DNA, 201 bp, Homo sapiens
attccataaaaatgaaaattaaataagtacaagaatggttatatccgggggaggagccaacatggccgaataggaacagctccggtctacagctcccagcgtgagcgacacagaagatggtgatttctgcatttccaactgaggtaccgggttcatctcactagggactgccagacagtgggcgcaggtcagtgggtgcgt

SEQ ID NO: 14413 - DNA, 201 bp, Homo sapiens
cggggtttcaccctgttagccaggatggtctcgatctcctgacctcgtggtccgcctgcctcggcctcccaaagtgctgggattacagacctgaaccaccgcgccgggccagttctgtgggtttctaacgtgctttcttccacttgtaatttagagtcagaagaggctagcgctgacaggcaggcagtagtcacatgaaaa

SEQ ID NO: 14414 - DNA, 201 bp, Homo sapiens
ctactaaaaatacaaaaaattagccgggcgtggtggtgggcgcctgtaatcccagctactcgggaggctgaggcagaagaatggcatgaacccaagaggcggagcttgcagtgagccgggatagcgccactgcagtccagcttgggcgaaagagtgagactccgtctcaaaaaaaaaaaaaaaaaaaaaaaaaaaagactt

SEQ ID NO: 14415 - DNA, 201 bp, Homo sapiens
ggagggtggtgagggtggggagggggaaggcgggaggccgggttcggtgcatgggggccgggcacactttctctgggcatccctaggacaggcgaggaacgcatcggccgggactccacctacgagcaggagggcaaggtgcagtttgtgattgatgcggtgtacgccattgcccacgccctccacagcatgcaccaggcg

SEQ ID NO: 14416 - DNA, 201 bp, Homo sapiens
ctacacaagtcgtagtctgggcagacgctgcacttgtagcgggttcctaccacaggcccattgcagccatcgcagatcacattggggtgcaccatgttgcggggcgcctcctgagcacacggtgggcggtggtcccgccggcactcttttttctctacaggaagggtaaagagagccgctagggtgggaccccctaaagtc

SEQ ID NO: 14417 - DNA, 201 bp, Homo sapiens
tatggggaaaccctgtctctactaaaaatacaaaaattagcccggcgtggtggcacataactgtaaccccagctactcgggaggctgaggcaggagaatcgctggaacccgggaggcggagcctgcagtgagccaagattgcgccatgcactccaacctgggcgtcgcagcgagactctgtctctaaataaataaagtgcc

SEQ ID NO: 14418 - DNA, 201 bp, Homo sapiens
agcaatcaacaaagtgaagacatggcccactgaagcgcagaaaatatttacaagccgggcgcggtagctcacgcctgtaatcccagcactttgggaggccgagacacgcggatcacaaggtcaggagatcgagaccatcctggctaacacagtgaaaccctgtctctactacaaatagaaaaaattagttgggcatggtgg

SEQ ID NO: 14419 - DNA, 227 bp, Homo sapiens
agattggcttctttcacttaataatatgcatttcaatttctagggctgggcgtggtggctcacgcctgtaatcccagcactttgggaggccgaggccggcggatcacgaggtcaggagatcaagacgatcctggctaacatggtgaaaccccgtctctactaaaaatacagaaaataagccgggcgtggtggcgggcacctgtagttccagctactcaggaggctga

SEQ ID NO: 14420 - DNA, 201 bp, Homo sapiens
gttccctttccgagtcaaagaaaggggtgacggacgcacctggaaaatcgggtcactcccacccgaatattgcgcttttccgaccggcttaaaaaacggcgcaccacgagattatatcccacacctggctcggagtctcgctgattgctagcacagcagtctgagatcaaactgcaaggtggcagcaaggctgggggaggg

SEQ ID NO: 14421 - DNA, 201 bp, Homo sapiens
acgcagaagacgggtgatttctgcatttccatctgaggtaccgggttcatctcacttgggagagccagacagtgggcgcaggtcagtgggggcatgcaccgtgcgcgagccgaagcagggagaggcattgcctcacttgggaagcgcaaggggtcagggagttccctttccgagtcaaagaaaggggtgacagacgcacct

SEQ ID NO: 14422 - DNA, 201 bp, Homo sapiens
ggcacccgccaccacgcccggctaattttttgtattcacagtacagacggggtttcaccgtgttagccaggatggtttcgatctcctgacctcgtgatccgcccgcctctgcctcccaaagtgctgggattacaggcgtgagccaccgcgcccggtggaaaggacacttttttacagtatgagcactgaaacaaaaaggca

SEQ ID NO: 14423 - DNA, 201 bp, Homo sapiens
aaccgtgtcactggaagttaggaagcaaacttcaatcctagtattgtttttttttgaaatggagtctcgctctgtcacccaggctggagtgcagtggcgcgatctcggctcactgcaagctccgcctcccgggttcaccccattctcctgcctcagcctcccgagtagctgggactacaggtgcccgccaccacgcccggc

SEQ ID NO: 14424 - DNA, 201 bp, Homo sapiens
tctgggtgaccgtctgcaatggagggagtgtgtgggctggtttgccagcggagagatttgcctcacgtcaccaggagcctggccgagcaccacggtgaccgtggccgggtggaaggagatggacgcccacttgtgcaatttgcttccattctttctccaggggccatttcagaataaaatgtaatggccctttcttgttca

SEQ ID NO: 14425 - DNA, 201 bp, Homo sapiens
acaagctggctgcccggcaggccacaccggggtctctaagagcttgggctgcagacgaatccaggtctgcccctctcaatcagtgtgactcgggcaagccgcgtcccccctctgagcctcagtctcctcatctctcaaatgggggtgacgccatccccactgccaggggttcctctgagcgggtcacaggaaggtgcttag

SEQ ID NO: 14426 - DNA, 201 bp, Homo sapiens
cccagcctgggatcggcagtaccttcacctgcacgccatcctcagggacggcaatactgctcaccttgagcccagagcagctactatccccggcccctccgctggctttctgggaggtcccaggaagacgtgacctcttgtcaggcactcgtgggctcccccatagctgccggggtggttcttgcccctccaaaatcacac

SEQ ID NO: 14427 - DNA, 201 bp, Homo sapiens
aaagctaccgtaggtaatcagaaaagttgcttccattccatggctgtgtccacctgcggtagacaggataatggcccaaagatgtctgagacccgtgaccgtcttaccctgtgaccgtattaccccacatggcaaagaagcctctgtacgtgtgactacgattaaggaccttgagattcggagatgacctgggtatccggg

SEQ ID NO: 14428 - DNA, 201 bp, Homo sapiens
gtggcggcaggtttgctgcgctcgtcccagccagggcccagagtccctcggccagtttatcgcatctggaccccagatgggcgcgttgggtggtgcccgcgccagggaaagagctggcggctggctgagttgctgcgttcctgagcgctgtgcccgttgtgaccattggcgtggctgtctcccggcaggctcgaaggaatc

SEQ ID NO: 14429 - DNA, 201 bp, Homo sapiens
cccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaagg

SEQ ID NO: 14430 - DNA, 201 bp, Homo sapiens
gggttcagaggcacttcagcaaatggtttaggaactgcagcattaatttatactgagaaatagaactgctacttaagaaagataactgccggcccaatgcggtggctcacgcctgtaatcccagcactttgggaggccgaggctggcggatcacgaggtcaggagatcgagaccatcctggctaacagggtgaaaccctgt

SEQ ID NO: 14431 - DNA, 201 bp, Homo sapiens
cacggtgaaaccctgtctctactaaaaatacaaaaaattagccaggtgtggaggcactccctgtaatcccagatactcaggaggctgaggcaggaaaatcgcttgaacccgggaggtggagtttgcagtgagctgatatcgcaccactgtgctccagcctgggcaacagagcaaaattctgtctcaaaaaaaaaaaaaaaa

SEQ ID NO: 14432 - DNA, 201 bp, Homo sapiens
cattctcctgcctcagccttaggagtagctgggactacaggcgtccgccacaacgcccggctaattttttttgtatttttagtggagacggggtttcaccgtgctagccaggatggtctcgatttcctgacctcgtgatctacccgcctcagcctcccaaagtgctgggattacaggtgtgagccaccgcgcccagctgtt

SEQ ID NO: 14433 - DNA, 201 bp, Homo sapiens
gtctacagctcccagcgtgagcgatgcagaagacgggtgatttctgcatttccatctgaggtaccgggttcatctcactagggagggccagacagtgggcgcaggtcagtgggtgcgcgcaccgtgcgccagccaaagcagggcaaggcattgcctcacttgggaagcgcaaggggtcagggagttccctttccgagtcaa

SEQ ID NO: 14434 - DNA, 201 bp, Homo sapiens
tggcaaaaccccatctctactaaaaatacaaagacttagtatgggcatggtggtgcacacctgcaatcccagctgcttgggaggctgaagcagaagaatcgcgtgaacccgggaggcagaagttgcagtgagccaagatcacgccactgcactccagcctgggtgacacaacgagattctgtctaaaaaacaaaataaaaa

SEQ ID NO: 14435 - DNA, 201 bp, Homo sapiens
aaatcttctatttctttgaggcagagtctcactctgtcgcccaggctggagtgcagtagcgtgatctcggttcactgcaagctccacctcccgggttcacgccattctcctgcctcagcctcctgagtagctgcgactacaggtgcccttcaccacgccgggctaattttttgtatttttagtagagacggggtttcactg

SEQ ID NO: 14436 - DNA, 201 bp, Homo sapiens
tcccgagtagctgggactacaggcgcccgccactacgcccggctaatattttgtatttttagtagagacggggtttcaccgcgttagccaggatggtctcgatctcctgacctcgtgatctgcctgcttcggcctcccaaagtgctgggattacaggcgtgagccaccgcgcccggcttattttttttatttttcacagag

SEQ ID NO: 14437 - DNA, 201 bp, Homo sapiens
tgagccgagcggagattgcgccactgctctccagcctgggtgacagagggagaccctgtgtctaaaaaaaatagatgcaggtaggagcttttcttccggcgctcatactcagactgaagaaagtaattgggctgggcccggtggctcagatctgtaattccagcactttgggaggcccaggcagacgtatcactttagctc

SEQ ID NO: 14438 - DNA, 201 bp, Homo sapiens
ctggagcagtggcaggtggcaagggctgggtggggggttgccccactgggctctctatttttctctccttcccccaactttttttttttttttttgagacggagtcttgctctgccactcaggctggagtaaagaggtatgatctcggctcacagcaacctctgcctcccgggttcaagtgactctcctgcctcatgctcc

SEQ ID NO: 14439 - DNA, 201 bp, Homo sapiens
tgaagggagggacgagagtcctaccatctaaccccaagcctagtggccggtgtccctggaagtggagacacatgctcactggtgtgcgactcacacttacgaaagggaacgtgccctctggaacacaggggagccctggtcagggaagccgtctttccacccaagagggacaaaggtgtgcaaatcccagaaaccagatat

SEQ ID NO: 14440 - DNA, 201 bp, Homo sapiens
aaatcatctctgatttgagatataaaaataaagaggccgggcgcaaggtggctcacgcctgtaatcccagcactttgggaggccgaggcgggcggatcacgaggtcagcagatcgagaccatcctggctaatacggtgaaaccccgtctctactaaacaaaacacaaaaaattagccgggcgtggtggcgggcgcctgtag

SEQ ID NO: 14441 - DNA, 217 bp, Homo sapiens
ttttgaatgaaattaggaaggagaaagtatgggacaatgggcttttgataatgataaaaagagaaaaaacaaatagaaaaaagaggagggtcggccgggcgcggtcaggaaggcgcggtctcggtcaggagatcgagaccatcctggctaacgcggtgaagccccgtctctactaaaaatacaaaaaattagccgggcgtggtggggggcgcctgta

SEQ ID NO: 14442 - DNA, 217 bp, Homo sapiens
ccgtcacccctttctttgactgggaaagggaactccctgaccccttgcccttcccaagtgaggcagtgcctcgccctgcttcggctcgcgcacggtgcacgcactcactgacctgcgcccactgtctggcactccctagtgagatgaacccggtacctcagatggaaatgcagaaatcacccgtcttctgcgtcgctcaagctgggagctgtagacc

SEQ ID NO: 14443 - DNA, 201 bp, Homo sapiens
tgctggtgggagttaaaatggatcaactacataaaaaacaatttccaggccgggcgcagtggctcacgcctgtaatcccggcactttgggaggccaaggcgggcggatcacgaggtcaggaaatcgacaccatcctggttaacaaggtgaaaccccatctctactaaaaatacaaaaatttagccgggcgtggtggcgggc

SEQ ID NO: 14444 - DNA, 201 bp, Homo sapiens
tggagatttcccacttattgtggcagcaaacccgtctgaggtgcctgcatgtctcagtcccggggctccgggggccgtgcccacagcctccccatctttcggctcccacgtcagggttcccggtccacaccgtgctgttctgcctcatatgagaccggaaagtcacatgtggataattcaggacttattcagggtcatata

SEQ ID NO: 14445 - DNA, 201 bp, Homo sapiens
gtagggtccgaacctcttccccaggagggccagggttgcggccgggcgacgccaggtggggaagacactagaagaggagaaaaccaggagcgcaggacgcggtgggagactgggaggctgcagagaggaggcctgaggacaggagggaaggaggcggggacagaggccgagggctggaggggctgccgggtcttctctggg

SEQ ID NO: 14446 - DNA, 201 bp, Homo sapiens
gccaccgcgcccggctaatttttttgtatttttttagtagagtcggggtttcaccgtgttagccaggatggtcacgatctcctgaccttgtgatccggccgcctcggcctcccaaagtgctgggattacaggcgttaagccaccgcgcccggccgatagtcagactcttaaaggtgtttgaatttttccaatgtggaaaca

SEQ ID NO: 14447 - DNA, 201 bp, Homo sapiens
agctcacgcacggtgcgcgcacccactgacctgcacccactgtctggcactccctagtgagatgaacccggtacctcagatggaaatacagaaatcacccgtcttctgcgtcgctcacagtgggagctgtagaccggagctgttcctattcggccatcttggctcgatccggagtggcacacgcttctaaacaaccaaatc

SEQ ID NO: 14448 - DNA, 201 bp, Homo sapiens
ctggcgagaagtcgagcacagcagctgctggcccaggtgctaagcccctcactgcccggggctgctggccgctccaagtgcgggccagcccagcccacgcgcacccggaagtcgcgctggtgagggagggctgcgagggctgccagcatgctatcacctctcactgggattacaggcgtgagccacggcgcccggccgaag

SEQ ID NO: 14449 - DNA, 201 bp, Homo sapiens
tcacgccattcttctgcctcagcctgtagctgggactacaggtgcccgccaccacgcccggctactttttctgtatttttaatagagacggggtttcaccgtgttagccaggatggtctcaatctgctgatctcgtgatccgcccgcctcggcctcccaaagttctgggattgcaggagtgagccaccgcgcccggccgca

SEQ ID NO: 14450 - DNA, 201 bp, Homo sapiens
cagactggagtgcagtggcacgacctcggcttagaacctccgcctcatgggttcaagcaattcccctgcctcagcctccggagtagctgggactacaggcgcccgccaccacgccaggctaattttttgtatttttagtagggacggctgaccgggcgcggtggctcacgcctgtaaccccagcactttgggaggccgagg

SEQ ID NO: 14451 - DNA, 201 bp, Homo sapiens
cacttcccagatgggatagcggccgggaagaggcgctcctcacttcctagatgggatggcggccaggcagagacgctcctcacttctcagacggggtggcggccgggcagaggctgcaatctcggcactttgggaggccaaggcaggctgctgggaggtgaaggttgtagcgagccgagatcacgccactgcactccagcc

SEQ ID NO: 14452 - DNA, 201 bp, Homo sapiens
gatggagctgcctgccagtcccggtactgtgcgcccgcactcctcagcccttgggtggtcaatgggactgggtgccgtggagcagggggtggcgctcgtcggggaggctcgggccgcacaggagcccacggaaggggtgggaggctcaggcatggcgggctgcaggtcccgagccctgccccgcgggaaggcagctaaggc

SEQ ID NO: 14453 - DNA, 286 bp, Homo sapiens
gagccaggtgtgggatatagtctcgtggtgcaccgttttttaagccggtctgaaaagcgcaataatcgggtgggagtgacccgattttccaggtgcgtccgtcacccatttatttgactcggaaagggaactctctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttc

SEQ ID NO: 14454 - DNA, 201 bp, Homo sapiens
aggcaaagctgcctgccagtcccatgccttgtgcccacgctcctcagccgttccacagtcgatgggaccgggtgccatggagcagggggcggtgctcgtcggggaggctcctgctgcacaggagcctagggcagtggggggaggctcacacatggcaggctgcaggtcccaagccctgccccgcagggaggcagctgaggc

SEQ ID NO: 14455 - DNA, 201 bp, Homo sapiens
aggcgggtggatcacgaggtcaggggttcgagacgagcctggccaacatggtgaaactccgtctctactaaaaatacaaaaattagttgggcgtggaggcgcgcgcctgtaatcccagatactcgggaggctgaggcaagagaatcgcctgaacccgggaggcggaggttgcagtgagccgagatggtgccattgcactcc

SEQ ID NO: 14456 - DNA, 201 bp, Homo sapiens
gagcgacgcagaagacgggtgatttctgcatttccatctgaggtaccgggttcatctcactagggagtgccagacagtgggcgcaggtcagtgggtgtgcgcaatgtgcgcgagccgaagcagggcgaggcattgcctcactcgggaagcgcaaggggtcagggagttccctttccgagtcaaaggaaggggtgacggagg

SEQ ID NO: 14457 - DNA, 201 bp, Homo sapiens
gtgccgtctgtcacccctttctttgactaggaaagggaactccctgaccccctgcgcttccggagtgaggcaatgcctcgccctgcttcagctcgcacacggtgcatgcacccacggacctgcgcccactgtctggcactccctagtgagatgaacccggtacctcagatggaaatgcagaaatcacccgtcttctgcgtc

SEQ ID NO: 14458 - DNA, 201 bp, Homo sapiens
atcttcatttgaattctgacagcagctactatgtagagctgttaaaatgtatacttccggccgggtgcggtggctcacgcctgtaatcccagcactttgcggggccgaggcgggcggatcacgaggtcaagagatcaagactatcctggccaacatggtgaaaccctgtctctattaaaaatataaaaaaaattagctggg

SEQ ID NO: 14459 - DNA, 201 bp, Homo sapiens
ccaggtgccatccgtcacccctttccctgactcagaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctg

SEQ ID NO: 14460 - DNA, 201 bp, Homo sapiens
ttcagcccaccgctgcactgtgagagcccctttctgggctggccaaggccagagcccgctccctcagcttgcagggaggtgtggatggagaggcgtgagcgggaacccaggctgtgcatggtgcttgcgggccagctggagttccgggtgggcgtgggcttggcaggccccgcactgggagcagccggccggccctgccag

SEQ ID NO: 14461 - DNA, 201 bp, Homo sapiens
ggggagagggactgaccccttgtgctccacccccagctcatccaaccccagtgcagcctggagactgccaccgtgccccccggagggcgatggagcctccgctctgctcaggagcagcctggcttccgggagggcagcctgactcccacggcactgccggtgacccctcagctcaggccccggggctgcgagaatctcaag

SEQ ID NO: 14462 - DNA, 201 bp, Homo sapiens
atgagcgtcaccgacggcagagtcgccttctccatgttctgtggggaccgggaagagaccgcagggagtgaggcaccccactcgcccactcggcagacccgaagactgagacccgagagcccgcagccccgggtcacacccccagcgtttggcccagcccctcctccacctccccacccgccccctgcagacgaggggttt

SEQ ID NO: 14463 - DNA, 201 bp, Homo sapiens
gttgtaactttactgagtgtgcctgtctaccagacacctgatcttgcaagactgctttttttttttttttttgacggagtctcgctctgtcgcccaggccgaagtgcagtggcgcgatctcggctcactgcaagctccgcctcccgggttcatgccattctcctgcctcagcctcccgagtagctgggactacaggcgccc

SEQ ID NO: 14464 - DNA, 210 bp, Homo sapiens
ttctgggttcccacttcttttttttttttttttttttttctgagacgaagtctcactctgtcgcccgggctggagtgctgtggcaggatctcggctcaccgcaagctccgcctcccggattcacgccattctcctgcctcagcctcccgagcagctgggactagaggcgcccgccaccgcgccaggctaatttttttgtatttttagtag

SEQ ID NO: 14465 - DNA, 201 bp, Homo sapiens
caagctgggcgcggtggctcacgcctgtaatcccagcactttgggaggcccaggcaggcggatcacgaggtcaggagatcaagaccatcctggctaacacggtgagaaccccgtctctataaaaaatacaaaaaattagccgggtgcctgtagtcccagctactcgggaggctgaggcgagagaatggcgtgaacccgggg

SEQ ID NO: 14466 - DNA, 201 bp, Homo sapiens
gggttaaagaggaatcggaaagggcccggggtagacgtgggcgccacagggtgagccgggccaggctgagaggactcacgggctatgggagcttgtgggcgacggtccggcaggggcctgcggcgggaacagggacaaaatatacttaataaattgcccatttagagcaagttgtgtgggtacaatggcgagaaaacggtc

SEQ ID NO: 14467 - DNA, 201 bp, Homo sapiens
ggcgggtgggtcacgaagtcaggagatcgagaccatcctggctaatatggtgaaaccccatctctactaaaaatacaaaaaattagcctggcacagtggcgggcgcctgtagtcccagctagcccggaggctgaggcaggagaatggcgtgaacccgggaggcggagcttgcagtgagccgagattgcgccactgcactac

SEQ ID NO: 14468 - DNA, 201 bp, Homo sapiens
gttcatgccatcctaacagtgggtttttccccggtgagaactggccaacagtcattgcctcgcctctttagtatgttgtttgaccagagagggacagggcggggaggaaaaccggggcgccgtgggctgcagttccagctgcaaatacgggagtttcttccgacgtctgtggcccgccggctcgaaagggagaaacacgga

SEQ ID NO: 14469 - DNA, 201 bp, Homo sapiens
tcatgaactcctgagctcaagtgatccccccacctggccttgcgaagtgctgggattacatgtgtgagccaccacgtcgggattacaggtgtgagccaccgcgccgggattatgggcatgagccactgcgccggcctctagtaaacattttatcagtatccagtgaattctgggtctttgtggaacaggaatgtttgttcc

SEQ ID NO: 14470 - DNA, 201 bp, Homo sapiens
aggctgaggctggtggatcacaaggtcaggagatcgagaccatcctggctaacatggtgaaaccccgtctttactaaaaatacaaaaaaattagccgggcgtggtggtgtgcacctgtagtcccagctactcgggagcctgaggcaggagaatggcatgaacccgggaggcagagcttgcagtgagccaaaattgcaccac

SEQ ID NO: 14471 - DNA, 201 bp, Homo sapiens
aaggagatgcctgggccaggactgaagtctcccggaacaacgggctgggaccctgaggctggcaggggtgcagtgggcactgggtccatgtgtggcttgcgctggccgacgtgggcacacaaggggcacagctgccactgggggcctggaggggaggacccagctggggtctggagggccaggattttgcagaaggtttac

SEQ ID NO: 14472 - DNA, 201 bp, Homo sapiens
catggtgaaaccccgtctcaactaaaagtactaaaattacctgggcatggtggcacatgcctgtaatcccagctactcgggaggctgaggcaggagaatcgcttgagcccgggaggcggaggttgtagtgagccgtgatcgcgccactgcactccagcctgggcgatagagcaagactccatcttaataaaaaaattaaaa

SEQ ID NO: 14473 - DNA, 201 bp, Homo sapiens
gcgattctcctgcctcagcctcccgagcagctaggactacaggcgcccgcccccacgcccggctaattttttgtatttttggtagagacggggtttcaccgtgttagcaaggatagtctcgatctcttgacctcgtgattcgcctgcctcggcgttccaaagtgctgggattacaggcatgagccaccgcgcctggcgggg

SEQ ID NO: 14474 - DNA, 201 bp, Homo sapiens
agtgaaacccctctctactaaaaattcaaaaaaattagccgggtgtggtagcatgtgcctgtagtcccagctactcgagaggttgagacaggagaatggcgtgaacccgggaggcggagcttgcagtgagccgagatcgtgccactgcaccccagcgtgggcgacagagcaagactccgtctcaaaaaaaaagaaaataat

SEQ ID NO: 14475 - DNA, 201 bp, Homo sapiens
agatcatagatgaatttgaatcccaagtagcacagatgcgtcacacccatcatcctgccgctgaccatccccgggaccacatcacacccatcatcccgccgctgaccatccccgggaccaccatggcgggtcatgacagcacgtccttcctagaaacacgtctgaatagtacaagaaaaggacaccacccggattcgcgga

SEQ ID NO: 14476 - DNA, 201 bp, Homo sapiens
cgctgccacctacaagagctcctcctcccttgcaaccaatggccttgttcctggcttgtccagcaaactgaaaccatcgaaaaaggactttgccgggagcggtggctcacgcctgtaataccagcactttgggaggccgaggcgggctgatcacaaggtcaggaaatcgagaccatcctggctaacacggtgaaacccagt

SEQ ID NO: 14477 - DNA, 201 bp, Homo sapiens
ccagagccaggcgcctatcgtcaacccggagtgtgtgctccagccctctggggtcgaccctggttgctgggtcagtagtgtgaatctcctctcctcacacggggcccctaagacacgtgtttgtgtgtgtccgtccctaagacacgtgtgtgtgtatatgtgtgtgtgtgtgtgtgttccacatgaacgatttgagtcacc

SEQ ID NO: 14478 - DNA, 201 bp, Homo sapiens
gccagtgccttcacggcagcccctgcactgggcccggggtgggggcggggggtggttgtggagtccctggctttcacccagcgtgtctccttcacggggcgcaccccaaagcgacaagatgtttcccaggaaatggggaatggacgccaggctttcagggagaggttgaggcagcctgaggtaaaaagggacgggccgagg

SEQ ID NO: 14479 - DNA, 201 bp, Homo sapiens
gggtgttcatggagtccctagctttcacccagggtgcgtgtcttccccacggggggcaccccaaaggggcatgaagtttcccgggggatggggatatgacgccaggctttcagtgggacactgagacagccgggggaaaaaagccgggagggcaagaaggctggggcacttccatggaggccagttccttcccagcagcct

SEQ ID NO: 14480 - DNA, 201 bp, Homo sapiens
gcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggt

SEQ ID NO: 14481 - DNA, 201 bp, Homo sapiens
gcaggtgccagggagaggcaacttcccaaacagataaaaacacttctggccgggcgcggtggctcatgcctgtaatcccagcacttcgggaggccgacgcgggcggatcacgaggccaggagatcgagaccatccttgctaacacggtgaaaccccgtctctattaaaaatacaaaaaattagccgggtgtggtggcgggc

SEQ ID NO: 14482 - DNA, 201 bp, Homo sapiens
tggtttcaccatgttagccaggatggtctcaatctcctgacctcgtgatccgcccgccacggcctccgaaagtgctgtgattacaggcatgagccaccgcgcccggcctaaaataactcttgaggttacataagaacatagtttatgtttacttatagctgtatctaatctaattaagaacttgttccttaagatgaaaaa

SEQ ID NO: 14483 - DNA, 201 bp, Homo sapiens
cgggctcccgacttgcgtggatgagcagttctgagccttacacagggcgggtgacgctgcagactgacaaggcccatccctggccacactgagccaaagcggaaggggtgcaggtgtggagtgccatgtgcgatgccactgccggccagctggagtggaggtgcccgccatgtgcatggggagacgtgcccctggttagcc

SEQ ID NO: 14484 - DNA, 366 bp, Homo sapiens
ccgccttgcagtttgatctcagactgctgtgctagcaatcagtgagattccgtgggcgtaggaccctccaagccaggtgtgggatatagtctcgtggtgcgccattttttaagccggtctgaaaagcgcaatattcgggtgggagtgacccgattttctaggtgcgtcggtcacccctttccttgactcggaaagggaactccctgacccctggcgcttcccaggtgaggcaatgcctcgccctgcttcggctcgcccacggtgcgcgcacccactggcctgcgcccactgcctggcactccctagtgaggtgaacccggtacctcagatggaaatgcagaaatcacccgtcttctgcgtcgctca

SEQ ID NO: 14485 - DNA, 201 bp, Homo sapiens
ggctcctgcagggccgagcctccccaatgagcgctgccccctgctccacggcgcccggtcccatcgaccgcccaagggctgaggactgtgggagcactgcgcgggactggcaggcagctccacctgcggcccccggtgcgggatccactgggtgaagccagctgggctcgtgagtctagtgtggacttggagaacctttat

SEQ ID NO: 14486 - DNA, 201 bp, Homo sapiens
cgcagaagatgagtgatttctgcatttccatatgaggtaccgggttcatctcactagggagtgccagacagtgggcgcaggacagtgggtgcagcgcaccgcacgcgagccgaagcagggcgaggcattgcctcactccggaagcacaaggggtcagggagttccctttcctagtcaaagaaaggggtgacagacggcacc

SEQ ID NO: 14487 - DNA, 201 bp, Homo sapiens
ttccctttcccagtcaaagaaaggggtgacagacagcacctggaaaatcgggtcactccaaccggaatactgcacttttccaacaggcttaaaaaacggcgcacctggagattgtatcccgcacctggctcggagggtcctatgcccacggagtctcgctgattgctagcacagcagtctgagatcaaactgcaaggcggc

SEQ ID NO: 14488 - DNA, 384 bp, Homo sapiens
ttcgtttctttggcctctgttgcccatgagaaatgaggaaaaataaaggccagattcctaataaccttcccggaagaaagagctgttttgagtgggtgtcggtgcttacatacgctgcttttaaaaaaatttgctttgttcaggtttgtgtgaatacaacgccggatgaactctgtcccttcagaagaaagccgggttggtgtgctcgatgacgcagcgcttgcagtggcgtttgacaaagcgcagggcctccacggagacctcgcagtcctggacattcagcgtctggaggtcaaagcagttggcggccacgatctgcaagccctggccggtgatgctctcgcaggacttgaggctgagccgcttgaggttgaagcagttcag

SEQ ID NO: 14489 - DNA, 216 bp, Homo sapiens
tgggagtgacccgattttccagctgcgtccatcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagattaacccggtacctcagatggaaatgcagaaatcacccgtcttc

SEQ ID NO: 14490 - DNA, 334 bp, Homo sapiens
ctgtgctggcaatcagcgagactccgtcgggtaggaccctccgagccagatgcgggatataatctcgtggtgcgccgttttttaggccggtccgaaaagcgcaatattcgggtgggagtgacccgattttccaggtgcgtccgtcacccctttctttgactaggaaagggaactccctgacccctggcgcttcccgagtgaggcattgccttaccctgcttcggctcgcgcacggtgcgcgcacccactgacctgtgcccactgtctggcactccctagtgagatgaacccggtacctcagatggaaatgcagaaatcaccgtcttctatgtca

SEQ ID NO: 14491 - DNA, 201 bp, Homo sapiens
ctcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccc

SEQ ID NO: 14492 - DNA, 270 bp, Homo sapiens
ccccggttcccgcccgtgcctctccctccacacctccccgcaagctgagggagccggctccggccttggccagcccaggaatgggcttccacagtgcagcggcgggctgaagggctcctcaagcgcggccagagtgggtgccaaggccgaggaggcgccaagagcgagcgagggctgtgagggctgccatgccggtacactgtcacttctcagaaggacgcagggcagagtttcaggctggctctgtcacccatgctggagtgcagtggc

SEQ ID NO: 14493 - DNA, 253 bp, Homo sapiens
ggtcggaaaagcgcagtattccggtgggagtgacccgattttccaggtgcgtccgtcacccctttctttgactcggaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctgtcttccacgtcgctcacg

SEQ ID NO: 14494 - DNA, 204 bp, Homo sapiens
taaattagtaaactcaacacttcaggatctttgttaagaagcttggttttggccgggaggatggagttcagcgggcagcggagctgtctcagtctttgccgccgccccgtccgggagggaggtggggggggtcagcccccctgcccggccagccgccccgtccgggaggtgaggggcgcctctgcccggccgcccctactggga

SEQ ID NO: 14495 - DNA, 228 bp, Homo sapiens
actcgggaagcacaaggggtcagggagttccctttcctggtcaaggaaaggggtgacagacagcacgtggaaaatcaggcctctcccacccgaatactgcgcttttcctacgggcttaaaaaccggcgcatcaggagactatatcccgcacctggctcggagggtcctacgcccacggagtctcgccgattgctagcacagcagtctgagatcaaactgcaaggtagc

SEQ ID NO: 14496 - DNA, 217 bp, Homo sapiens
cccagtggccgcaggggctgtcgtgtgctttgcagatggacacgcgctatttaacatagagatgcgctgagtccgggtgattagtgaatcgcacgtcatcgcagacactagaaagcgaaagcatacgggggaaggccccgggcacagacccagcacggccaccactcgagctggagctgcctgcgagacgatgagcgtctgcaatctgcatcctgcg

SEQ ID NO: 14497 - DNA, 201 bp, Homo sapiens
tccggtgtttaacccctgaattctaaggaaaaatagggcagaatagaaagtgaaacaggtccgaaggtactcaccgtgtggcaatatcccagacgagtccgatggtactcaccgtgtggcaatatcccagacgaacacccaagatgtgtccggagttggttccttccagtgggcttgtggtctcagtgacttcaagaatga

SEQ ID NO: 14498 - DNA, 204 bp, Homo sapiens
acggtgcgcacacccactgacctgtgcccactgtctggcactccctagtgagatgaacccggtacctccgatggaaatgcagaaatcacccattttccgcgtcgctcacgctgggagctgtagaccggagctgttcctatttggccatcttggctcctccccggcatttttcttactttttatttaggaccagtttgttgtctt

SEQ ID NO: 14499 - DNA, 223 bp, Homo sapiens
tagaagtacaagtaaccgtttccctctgcatcccagtggaacgtcgtgggtcttctgaagaccctctcttgccctgcaggctccggtactccaagcacgcgagtctgcgcaggaggcgcttcgctctccggagctccccactgcctcctagacacagtcccggctccttaccccgggcggaggctcttccagacgggtcccgactgcctctgtatgcccactg

SEQ ID NO: 14500 - DNA, 201 bp, Homo sapiens
tactcacaaggctgaggcaggagaattgcttgaagccgggaggcggaggctgcaatgagccgagatcacaccattgcatcccagcctgggcgacaagagcgaaactctgtaacaacatcaacaacaacaacaaaacaaaaacaaaaacaaaaaagaaaacaagagacgcggtggttctgcttgtaatcctagtactttggg

SEQ ID NO: 14501 - DNA, 203 bp, Homo sapiens
cctaatatcaagctaggtctagggaagtgctttttttttttttttttttttttatttgagacgtagtctcactctgtcacccaggctggagtacagtggcgcgatctcggctcactgcaagctccgcctcccgggttcacgctattctgctgcctcagcctcccgagtagctgggactaccgcccgaccaatttatttgtact

SEQ ID NO: 14502 - DNA, 201 bp, Homo sapiens
tacaaaaagaactacaaaacactgctgaaaaaaatcagacaacagccgggcgcggtgtctcatgcctgtaatcccagcagtttgggaggccgagttgggcggatcacgaggtcaggagacccagaccatcccggctaacacggtgaaacctcggtgaaacctcgtctctactaataatacaaaaaaattagccgggcgtgg

SEQ ID NO: 14503 - DNA, 201 bp, Homo sapiens
accattgttaaaaattaaattgggccgggcgcggtggctcacgcctgtaatcccagcactttggggggccgaggctggcggatcacgaggtcaggagatcgagaccatcctggctaacacggtgaaaccccatctctactaaaaatacaaaaaattagccgggcgaggtggcaggcacctgtagtcccagctactcgggag

SEQ ID NO: 14504 - DNA, 201 bp, Homo sapiens
tctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgactttt

SEQ ID NO: 14505 - DNA, 201 bp, Homo sapiens
gaggctgaggcaggagaatcatgtgaacccggaaggcggagcttgcagtgagccgagatcgcgccactgcactccagcctgggcgacagagcgagactccgcctcaaaaaaaaaaaaaaaaaaaaaaaaagtgacctgggccgggcgcggtggctcacgcctgtaatcccagcactttgggaggccgaggagggcagatca

SEQ ID NO: 14506 - DNA, 201 bp, Homo sapiens
tactagccaggcatggtagcacatgcctgtaatcccagctactcgggaggctgaggcaggagaatcgcttgaacccgggaggtggagattgcagtaagccgagttcgtgccatcctattccagcctgggcaagagcgaaactccactgggaaaaaaaaatccatagtttaggccgggcgcggtggctcacgcctgtaatcc

SEQ ID NO: 14507 - DNA, 201 bp, Homo sapiens
ggtcagccccccgcccggccagccgccccatccgggaggtgaggggcgcttctgcccggccgcccctactgggaagtgaggagcccctctgcccggccacgaccccgtctgggaggtgtgcccagcagctcattggggatgggccatgatgacaatggcggttttgtggaatagaaaggcgggaagggtggggaaaaaatt

SEQ ID NO: 14508 - DNA, 201 bp, Homo sapiens
actggccaaagagcactgtgggttctcggaagcacctgctcttccatcagctgtaaaccggaatgataaccagctcctaggctttggtttctgaatgtacgctgcgaacgatgcactgccttggcctcatggcaggggctggggaggcccgctctaccctgtaccccgacccgggcccaaagctgagcttgaagggccccc

SEQ ID NO: 14509 - DNA, 201 bp, Homo sapiens
cccgccactacgcccggctaattttttgtatttttagtagagacggggtttcaccgttttagctgggatggtcccgatctcctgacctcgtgatctgcccgcctcggtctcccaaagtgctgggattacaggcgtgagccaccgcacccggccccccctttttttttttttttttaagacagagtctcactctgctgccca

SEQ ID NO: 14510 - DNA, 201 bp, Homo sapiens
atctcggaaagtacaggaggtcatgccccagtgtggttcccctttcctgggtttaagtcaaggtcctcaccgtgcctgccggcctcccgggtctctgcgcggtggactctggacctccctgccccgtcctgcctcagggcctttgcacctgctgttaccgcggcctggaacgctcctcccctgaaaccctgtgactcccac

SEQ ID NO: 14511 - DNA, 201 bp, Homo sapiens
tgtgcttataagaacactagccattggatttagggcccacctaactcagtatgacctcatcttaacttgattacatctgaaaagacccttggccgggcgcggtggctcatgcctataatcccatcactttgggaggccgaggcaggtggatcacttgaggtcaggagttcgagaccagcctggccaacatggggaaatccc

SEQ ID NO: 14512 - DNA, 211 bp, Homo sapiens
cccagctctcaggacgtgcctcccatggctttctctgcggtgtggccacgcccggacttccttggcaccccccacctgccccgcacgacctgccctgcgcgacctgccccgcaaggccggggggagcgtcttcctcccccgcgacctcttacctcctcccggcactcgcccaccccgctgcccaggtctcctgctcctccggccctagggc

SEQ ID NO: 14513 - DNA, 201 bp, Homo sapiens
gtgcgcgcacccactgacctgcgcccactgtctggcactccctagtgagatgaaccgggtacctcagatgcaaatgcagaaatcacccgtcttctttgtcgctcacgctgggagctgtagaccggagctgttcctactcggccatcttggctcctccccccgaaaagagtatctttcaaccaagaagatggctttggctgc

SEQ ID NO: 14514 - DNA, 201 bp, Homo sapiens
acctagtggatcccacaccggggctgcaggtggagctgcctgccagtcctgcgccgtgtgctcacattcctcagcccttgggtggtcgatgggactgggcgccgtggagcagggggtggcactcgtccgggaggcttgggcggcacaggagcccatggagtgggtgggaggctcaggcatggtgggctgcaggtcctgagc

SEQ ID NO: 14515 - DNA, 201 bp, Homo sapiens
gatatgtacaggccatttaagagaatgatcgacttctggccacccggtgcctgcctgctgcggtggcgctgtgccgggcccaggggtcccagggactcccgccgtgctgtcagccttggaatctcagtggggacctgttgtgtggaaacttccggacaacagtctttcccatggagaacctacgtcttcacaatgttacca

SEQ ID NO: 14516 - DNA, 201 bp, Homo sapiens
ccactccttcatatctgtagagcgctctaccttctgtaacgtttatctgcgaaactgctgcgttaggccaggagcactccaagagcgagaggcagacgccgtctgacttttcaccctgacaggggacttttccacctggcagtgccaatatccggctcctacgcattctccatggaggatcaccaggtcagcccatgggag

SEQ ID NO: 14517 - DNA, 201 bp, Homo sapiens
ttctggcagagtcagcactcgactctccctgctcggagacccaggcgacggtgccgtgtgacccctgaccccgcggatgaggaaggtagagagagagcgcgcagacacggaggtcggcgctgaggttgagggagccacacccggccgcaagcttgagggagggaagccgggtgcggaaacagcccagcgggtccagaagtc

SEQ ID NO: 14518 - DNA, 201 bp, Homo sapiens
ccgctgccacgcccagctaattttttgtattgtttagtagagacggggtttcaccgtgttagccaggatggtctcgatctcctgaccttgtgatctgcccgcctcggcctcccaaagtgctgggattacaggcatgaaccaccgcacccggccaacctagtggttttgaggaggactcgtcaggagttttgtaaaatgtcc

SEQ ID NO: 14519 - DNA, 201 bp, Homo sapiens
accggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaaggtgcggttggggaaggggtcaggcccctggaaggatggggagggg

SEQ ID NO: 14520 - DNA, 201 bp, Homo sapiens
ttacaggtgtgagccacccggcctttttttttttttttttttttttttgagacgaagtctcactcttgtcccccaggctggagtgcaaaggcgcaatctcggctcactacaacctccacctcccgggttcaggcaattctcctgcctcaacccctggagtagctgggattacaggtgcctgccaccaggcctggctaattt

SEQ ID NO: 14521 - DNA, 201 bp, Homo sapiens
atcacccggcccagcaggtagaggcgcaggaacatggggatggacagcagcacgtccacgtcggcctcggccaccgagggcgcgtacgtgaaggccagccgcgccgtccacgtgaagcggtagtggccgggcaccgggtgaatggcgcacactgccagctctagcgagatgaggaacacgcgctcgcaggtcatggcgatg

SEQ ID NO: 14522 - DNA, 201 bp, Homo sapiens
gtagtcccagctactccaaaggcagaggtgagaatcgcttgaacccggaaggagtaggtttcagtgagctgaggtcatgccacttccctccagcctgggcgacagagaaagactctgtctagaaaaagtaaattatgggagtcggcgccggcgagcgccgcccgggaggcagcggctggaggagcggacgggccccgcggg

SEQ ID NO: 14523 - DNA, 201 bp, Homo sapiens
gaggctgaggcaggagaatggcgtgaacccgggaggcggagcttgcagtgagccgagatcccgccactgcactccagcctgggcgacagagcgagactccgtctcaaaaaaaaaataaaaataaaaataaaataaaataaaaaatgagctgggcatgatggcacaagcctgtggtcccagctactcaggaggctgaggtgg

SEQ ID NO: 14524 - DNA, 201 bp, Homo sapiens
gcagcttaataattctgcgttgcaaatttaaatattttacatatcattagacattaaaaacaaagatttatgctgctcgtctccacggagtgaggactccgttgacttcacacccggccatgaatctgcttgaggttcattagctgaacgtcttcggctaagaaagcccgtcgagtgggggcggcctctaaatcaccattt

SEQ ID NO: 14525 - DNA, 201 bp, Homo sapiens
gtgcatcttggctcactacaacctccaccacacccgcctctcccaggcttaagtgaccctcccacctcagtctccctagtagctgggactacaggtgcacggcaccatgaccggctaatttttgtattttttgtagagatgggattttgccatgttacccaggctggtctcgaactcctaagctaaagtaatccgcctgcc

SEQ ID NO: 14526 - DNA, 201 bp, Homo sapiens
ccccatctctactaaaaatacaaaaaattagccaggcgtggtggcacgccctgtaatcccagctactcgggaggctgaggcaggagaattgcttgaacgcgggttggggaggttgcggtgagccgagattgcaccactgcactccagcccgggtgacagtgcaagactccatctcaaaaaaaaaaaaaatctgtcaatcta

SEQ ID NO: 14527 - DNA, 201 bp, Homo sapiens
cacgtactacccacatgagccttcagtaggctccggccctaaataggcacatgcgtatttccccagctccttactgggatcctcccgctaagccacgcccgatgcccttgtctacagccatgagctgcagtaagatgcccaggcccggtgccagcgtgcgcagcacgtgtgccagcaccgtggaatccttgccgcccgagg

SEQ ID NO: 14528 - DNA, 201 bp, Homo sapiens
tggcactttggaaggccgacgtgggggcatcacctgagatcaggggttcgagaccagccttgcgaacgtgatgaaaccccgtctctactgaaaattcaacgattagccgggggtggtggtgcatgcctgtaatcctagctactcaggaggctgaggcaggagaatcgcttgaacccggaaggtggaagttgcaatgagccg

SEQ ID NO: 14529 - DNA, 201 bp, Homo sapiens
ctgaggtgggccgggcgcggtggctcacgcctgtaatctcaacactttgggaggccgaggggggtggatcacctgaggtgggcccggcgtggtggctcacgcctgtaatctcaacactttgggaggctgagaggggtggatcacctgaggtgggccgggcgcggtggctcacgcctgtaatctcaacactttgggaggccg

SEQ ID NO: 14530 - DNA, 201 bp, Homo sapiens
ggggtctcggccaggggtgggtgaggctggtgcccttccaggctcccctcagccacaggcagcaggtgccatgggagccctgccggcacccccttcctccgccagggtcctggttcatctgatggcgcagctcccctctaaggtgtgcaccggcgcagacactgtgcaggaagccaggctgatgcagacggttctcaagtc

SEQ ID NO: 14531 - DNA, 201 bp, Homo sapiens
aaagttgcccaaagtcccacaatgagttgatccaccgggaacaggaggaggccccgccgccagcctctgtgttatacttggcatctcgtccaggtttatcggagaggagatcacacgtcccttccccagccctcccaactcctccagccaagacaggtgccaccatctaccccagccccagtgtgctctgagtgtgccgga

SEQ ID NO: 14532 - DNA, 201 bp, Homo sapiens
cattctcctgcctcagcctcccgagcagctgggactacaggcgcccgccactgcgcccggctaattttttgtatttttttagtagagacggggtttcaccgtggtctcgatctcctgacctcgtgatccgcccacctcggcctcccaaagtgctgggattacaggcgtgagccaccgcgcccggccgtgtgtgttttttaa

SEQ ID NO: 14533 - DNA, 201 bp, Homo sapiens
gcacgtggcagcaggacttacctctggggtgccccgggtcggtgaactcatacttccccacgccaatggtccgcagcatctgcagcccgtgggccgagtcggttgtggggggcccattggtggcaggggcaccactggggagagtggcggacggctgggctggcggcggtggaggcagcaggggccctgccatgtggccgt

SEQ ID NO: 14534 - DNA, 279 bp, Homo sapiens
ggtggaagagctgacagcaaggggagtggccaaacggaggcggggcctggaagggggcgtggcttgcgggcctctgggccgcccggcctctttaggtgccgcagcggaaggcctggagcagaggctgcttctccgcccaagcactccctgggtgagtccatactcctggcgcgagtacgatcctctcctccagggaaggccgggtccctcgctggggttcgacccgactcttcccctctacccctttctccttgttctacacctagcgagcccaggccc

SEQ ID NO: 14535 - DNA, 201 bp, Homo sapiens
ctacacgggaggctgaggccagagaatggcgtgaacccgggaggcagagctcgcagtgagccgagatggcatcactgcactccagcctgggcgacagagcgagactcagtctcaaaaaaaaaaaaaaaaaaaaaggaaaatctaggttctttctcagactgaaatttctgtaaacataatttatgatttcatagcagccag

SEQ ID NO: 14536 - DNA, 201 bp, Homo sapiens
ctctgctgtaaaagaagtgcctatagaatctttattcttttttattattattattttttgagatagagtcgctgtcgcccgggttggagtacagtggcacgatctcggctaactgcaagctccgcctcccgggttcacgccattctcctgcctcagccccacccccccgccccgccccgccccgccccgccccgcccccga

SEQ ID NO: 14537 - DNA, 201 bp, Homo sapiens
gtttttctaacaccctgaaacttaaagtgtgatagtctcagaggactaccaacataagcatcacctgaaaacttgttagaaatgaagaactaggccgggcgcggtggctcacgcctataatcccagcactttgggaggcctagatgggaggatcacgacatcaggagaccgagaccatcctggctaacacggtgagacccc

SEQ ID NO: 14538 - DNA, 201 bp, Homo sapiens
catggtgaaaacctgtctctcctaaaaatacaaaaattagccaggcgtagtggcatgcgcctgtagacccagctacttgggtggctgaggcaggagaatcgctggaacccgggaggccgaggttgtagtgagccgagatcgtaccactgcactgcagcctgggtgacagaacaagactccaacttaaaaacaacaacaaca

SEQ ID NO: 14539 - DNA, 201 bp, Homo sapiens
tttgtccaggaaatgcacataggagctggtcactctgtgttttgagtcctctcggaggtgttggacttctagagagagaaacagagacacgtaagagggcgaagatgcctcagtggtgacacactggggagtcccgcccacgacccgtccacgaccggcacactcaacctgctccacggaaccccattccacagctcggtt

SEQ ID NO: 14540 - DNA, 201 bp, Homo sapiens
cgccaggacaagcgagggtggcctgagtcctgtgctcacatggcgtatgccgcccagtagatgacattgacggccgcaaacgccgcagggaacacagcgcgggcgtaaatgtcaatggtgtctgcgtcgatgggcctgagccgggcacggatgcccccctggcctcctgagcgggctgccccctccttcttcgtctcccct

SEQ ID NO: 14541 - DNA, 201 bp, Homo sapiens
cccctgttgagagtggactccgtgcgtgtgtcccccaggaacggtgacaagtacgacggcgactgggtccgggaccggcgtcagggacacggggtgctgcgctgcgccgacggctccacctacaaggtacccgggggcgcgcggcacctgctgcccagagggtacaggcctcgtggtgggcagggcgcgtggggtgtatgg

SEQ ID NO: 14542 - DNA, 201 bp, Homo sapiens
gataccataccctatattcttttattttttttgacccggagtctcgctctgtcgcccaggcttgggtgcagcagcgcgatctcggctcactgcaagctccgcctcccgggttcacatcattttcctgcctcagccttccgagtagctgggactacaggtgcccgccaccacgcccggctaattttttgtatttgtagtaga

SEQ ID NO: 14543 - DNA, 201 bp, Homo sapiens
ccccttcccagaaagcacatgaataggccgggcacggtggctcacgcctgtaatcccagcactttgggaggccgaggcgggtggatcacgtcagaagatcgagaccatcctggctaacacggtgaaaccccgtctctactaaaaatacaaaaaaaaataagccgggcgtggcagtgggcgcctgtggtcccagctactctg

SEQ ID NO: 14544 - DNA, 201 bp, Homo sapiens
gtgtgagagccacatgctaggaataagaggtatgccgagaggcggccgggcacggtggctcacgcctgtaatcccagcactttaggaggacgaggtgggcggatcacaaggtcaggagatcgagaccatcctggctaacatggtgaaaccccgtctctactaaaaatacaaaaaattagccgggcgtggtggcgggcgcct

SEQ ID NO: 14545 - DNA, 203 bp, Homo sapiens
ttccacaacgtctttcaccatctgtgagcacggcctgcaacgtggaagacacaaccccacctgactctccccagacctccctgctgctttagcctcctacgcgccagcctccgggccttcaccccaaaccttcccaggctcagaatgccctgccccaaactccaccgacaccatctgcgaaactgtagccttccatgaccaac

SEQ ID NO: 14546 - DNA, 201 bp, Homo sapiens
atcatacatggccgggcgcgatggctcacgccatcgagtgattgctgtaatcccagcactttgggaggccgagacgggaggatcacgaggtcaggagatcgagaccatcctggctaacacggtgaaaccccgtctctactaaaaaaacaaaaacattagccgggcgtggtggtgggcgcctgtagtcccagctacttggga

SEQ ID NO: 14547 - DNA, 201 bp, Homo sapiens
agtcccagctactcgggaggctgaggcaggagaatggcgtgaacccgggaggcggagcttgcagtgagccgagatcgcgccactgcactccagcctgggcgacagagcgagactccgtctcaaaaaataaaaataaataataataataattccagatattttacaataattttcaggcacaagagttttcacgagagtagg

SEQ ID NO: 14548 - DNA, 201 bp, Homo sapiens
tgggggtcccagaacttttgtagtttatatctctttggtcttttcctgggcagcttggaggcttccgaccttccggagcccctggtatttgagtttctccgtgaaagctcgtccgagaagggcttctgccccgggtctggcagactggagtcccttcctgggcttttttcttctttccctgggtgccttgtctctcgccaa

SEQ ID NO: 14549 - DNA, 201 bp, Homo sapiens
acgcgccaccacgcccggctaatttttgtatttttagtggagacggggtttcaccatgttggtcaggctggtctcaaactcctcacctcgtgatccgcccgcctcggcctcccaaagtgttgggattacaggagtgagccaccatgcccggccctaatctcagttttatagatgaaaaaacggaagctcaggatcagtgac

SEQ ID NO: 14550 - DNA, 201 bp, Homo sapiens
aagcagtatttggttttctgttcctgtgttaattcactccggataatggcctccagctgcatccatgttgctgcaaaggaccggattttgttctttttacgactgcatagtattccatggcatatatatatatacaccacattttcttaatccggtctatccatgtctttgctgttgtgaatagttctgcaatgaacatgc

SEQ ID NO: 14551 - DNA, 201 bp, Homo sapiens
ttaaataaatgccgggtgtcagggccgctgagtaagacaacaggccgcaaggacgcagcagaggaccctcggtcgatttgctgcgatggagtgagccagcggtgaggcctgaaggcccctgttttattttcccctcggagcagaggccggggagggtgctgggtgtcagcacagagcagagggccggtcacggaactgggg

SEQ ID NO: 14552 - DNA, 201 bp, Homo sapiens
gggagtgcagtggcgcgatctcggctcactgcaacttccgcctcccgggttcaagcgattctcctgcctcagcctccccagtaggtaggactacagtcgcgtgccaccacacccggctaattttttgtatttttagtagagactgggtttcaccatgttagccagaatggtctcaatctactgacctcgtgatccgcccgc

SEQ ID NO: 14553 - DNA, 201 bp, Homo sapiens
ttagtagaaacagggtttcaccatgttggccagaatggtcttgatctcttgaccttgtgatctgcccgcctcgctctcccaaagcgctgggattacaggcgtgagccactgcgccctgtccactgtccatcttcttttgctcgctctatcctgactgccggggccctggacactacacaaagagctagctggagagtgaga

SEQ ID NO: 14554 - DNA, 201 bp, Homo sapiens
ggaatgcagtggcgccatctcgctgactgcatcctccgcctcccggttgcaagtgattctcttgcctcagcctccccagtagctgggattacaggcgtgcgccacaacactcagctaatttttgtatctttagtagagacgggttttcaccaagttggccaggctggtctcgaactcctgaccccgtgatccgcctgcctt

SEQ ID NO: 14555 - DNA, 201 bp, Homo sapiens
cacctcggcctcccaaagtgctggtgttataggtgtgaaccatcgcacccggcctgctttttattttattatttatttattttttctgagactgagtctcgctcttgttgcccaggctggagtgtgcagtggctcaatctcggctcactgcaaactccgcctcccgggttcaagcgattctcctgcctcagccccctgagt

SEQ ID NO: 14556 - DNA, 3238 bp, Homo sapiens
tttttccccggactggctcaacttctcctttcaagcctggcatcctgttcccttccagcgggggatatcttgccgctttggggtgcccgtcgtgggcgccgcacgattctgggtgcaagccagagactccacaaacacgccgggccctgcgcagcggcttccgggaaggcactgtcatccgtgggagggcccggcccgccactttttaccccctgctgcctcaacgtcaccttccaagcctggcgtcctcttcccttcccctggaggccttcgtgctgctttggggtgccccctgtgggcgagacacacaacctgggtgcaagccagggactccgcgaccatccctggcccggcgcaggggtggccatccttgggacgacaccatcccgccacttttttccttggactgtctccactatccccttcaaccctggcgtcctgtacccttcccccagtggccttcttgccgctttgtggtgctccccgtgggtgagacacgcacccggggtgcaagacagggactccaggacgctcccgggcccactgcagaggctgctgggaaggcagtgtcgtccgtgagaggaccccagcatccccgctttttttccccggggctgcctcaacttcccccttcaagactgacgtgctgtccctttcccccgggaaccttcttgctgctttgtggtgcccgccgtgggcaagacactcaccctgggtgcaagccagggaatcaacaacccccgcatgcccggcaaaggggctgccggtaaggcactgtcattcgtgggatcaccccagcctcgctgcttttttctccaggctacctaaacgtccccattcaagcctggcgtcctgttgccttcccgcgggggacttcttgccactttggggtgccccccgtgggcgagacacgcacattgtgtgcaagacagggactccgcgaccctcccgggactggcataggggctgtagggaaggcactgtcatccgtgaaaggaccccagcctcgcccctttttttcctgggctgcctcaacgtcccctttcaagtctggcatcctgttcttccccccccggggctttcttgctgctttggggtgccacccgtgggcgaggcacgcaccctgggtgtaaaccagggactccaagacccccagggccaggcgcaggggatgtcgggaagtcactgtcctccgtggaaagtttttccctggactgcctcaaagtcccctttcaagcctggcatcctgttcccttcccccggagcccttcttgcagctttcgcgtgcacacttaggcgagacacgcactctgttgcaagacagggactccaaacccccccgcctgggccaggctcaggggctgccgggaaggcactgtggtctgtgggacgaccacagcctagccgctgttttcctctggctggcccaacgtccctcttcaagcctgacatgttgtccccttcccccgggggccctgttgccactttcacgtgcaccccgtgagcaagacaggcaccctgggtccaagccaggggctccaccgtccacctgggtcccactcagaggctgccgggaaggcactgttctcagtggaaattttttccccggactgcctcaacgtcccctttcaagctcggcgtcctgttcccttccactcggggacttcttaccgcattgcggtgcccatcgtgggcacgacacgcaccccgggtgcaagccagggactccacaaccaccccaggcccgatgcaggggctaccggacaagacactgttgtccttgggatgacaccggtctgcctcaactctacctttcaaccctggagtcctgtacccttcccctgggggccttcttgctgctttgtggtgccactcgtgggcgagacacacaacctgggagcaagccagagactccacgacacctctgggcccactgcagaggctgccaggaaggcggtgtcatccgtgggaggaccccagcttcaccacttttaccccggggccgcctcaacctccccttcaagcctgacgtgctctcccttcccccgggaatctacttgccgctttggggtgcccccttgagcgagacacgcaccctgggtgcaagccacggactccaggaccaccctggcccagcgaaggggctgccaggaaggcactgtcgtttgtgggagaaactcagcgtcgccgtttttttccacgggctacctcaaagtcccccttcaagtctgaggtgctgtccccttcccccaggggcctacttgccgctttggggtgcctcccatgggcgaaacacgcaccctgggtgcaagatagggactccacgatccccccgggcccagcgcagggactgccaggaaggcactgtcatccgtaggaggaacccgactagccgcttttctctctgtgctgcctcagcatccccattaaagcctggccttctgtggcgttcgcccggcggccttcttgccactttggggtgcccccatgggtgcgacccgcaccctcggtgcaagccagggactccacgaccaccccgggcctgacgcaggggctgctgggaaggcactgtcgtccatgggacgaccccagcctgccacgtttttccccggactgcctcaactatccctttcaaccctggcgtcccatacccttcccccggtggccttcttgccgctttgtggtgccccccgagggcgagacacgcaccttgggtgcaagccaaggactccatgacgctcccaggcccaccacagatgctgtcgggaagacagtgttatccgtggcaggaccccagcatcccctctttattcccggggctgcctcaacgtccccctccaagcctgacgtgctgtccccttcccctgggaacctacttgccgctttggggtgccccccgtggaaccctgggtgcaagcctgggacacaacaaccccctcgggcctggcaaaggggctgccgggaaggcaccgtggtccgtgggaagttttttcctggactgcttcaaagtcccctttcaagcctggcgtcctgttcccttcccagggggcattcttgccgctttggggtgtccccccgtgggcgcgacacgcaccctgggttcaagtcaggaactccacgacaaccccgagtctggcgcaggggctgccgggaaggcactgtcgtccgtgtgacgatcgctgcctgctgctttttccctcgtgctgcctcaacgtcacctttcacgcctggcgttcta

SEQ ID NO: 14557 - DNA, 201 bp, Homo sapiens
tgccacctcgcccggctaattttgtgtgtgtgtgtttttagtagagacggggtttcaccgtgttagccaggatggtctcgatctcctgacctcgtgatccgcccccctcggcctcccaaagtgctgggattacaggcgtgagccaccgcgcccggccttctgtatattattttctgagacactttgaggtaatagccttgg

SEQ ID NO: 14558 - DNA, 201 bp, Homo sapiens
cgacgcccaagcactcgagaacggtgaccaattattttggagagcacttgcaaaggcggccccctagccgtcctctccggaagccgcagtctttgtgtccgcccccgcaccttgcacacctgctgaggtggggcgtgttaatcatcaaattactaatgagtgatggcccaaattgcaggcagagtaatgaatagatggtgg

SEQ ID NO: 14559 - DNA, 201 bp, Homo sapiens
tgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgt

SEQ ID NO: 14560 - DNA, 201 bp, Homo sapiens
gggcgtggtggcgggtacttgtaatcccagctactcgggaggctgaggcaggagaatggtgtgaacccgggaggtggagcttgcagtgagccgagatcgcgccactgcactccagcctgggcgacagagcgagactccgtctcaaaaaaaaaaaaaaaaaaaaagaagaagtcagagcaaggaggcagaatgatccccagg

SEQ ID NO: 14561 - DNA, 201 bp, Homo sapiens
ggccagggcgcacgcggcgctggggcccggggggatgcccgctgtcccggccgcaccctggtcacgtacacctttgggggcggctgctccactgcagggcgcgggggcggagctcggcccaagaagagcggcaaagggcgggcggccctggcggcccagctcagggcccgggagtgcctgggggtccccccgtcccggggg

SEQ ID NO: 14562 - DNA, 201 bp, Homo sapiens
aaaaagcaaaaaacaaaaattagccggccatagtggtgggtgcctgtaatcccaactgctcgggaggctgagtcaggataatagcttgatcctgcggggcggaggttgccatgagccaaaatcgtgccacttcactccaggttgggcgcaagagcgagactctgtctcaaaaaaaaaaaaaaagtttcatgccgggcgccg

SEQ ID NO: 14563 - DNA, 201 bp, Homo sapiens
caggcgtgagccaccgcgcccggctatccctgataactttatttcaaatagtgacaggttaaaagttaagagcggatgtttcagtatctagtttcccagcgtcttgccagttactttaagcttgtcgacaggagtttgatttcactgacctccctccttcctagagctatgcttactttttaaaattttaagaagctgctt

SEQ ID NO: 14564 - DNA, 201 bp, Homo sapiens
actccggaggctgaggcaggagaatggcgtgaacgcgggaggtggagcttgcagtgagccgagatcgcgcctcctgacctcaggtgatctgcctgcctccgcacccggccaacctgtttttgtatacataatcttttcactgctcaatacatttcagggttcttcaatttcacacttcacacttcagcttcttcaatagat

SEQ ID NO: 14565 - DNA, 201 bp, Homo sapiens
cagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaaat

SEQ ID NO: 14566 - DNA, 201 bp, Homo sapiens
aggccgaggcaggcggatcacaaggtcagaatatcgagaccatcctgggtagcacgatgaaaccccgtctctatcaaaaaatacaaaaaattagccgggcgtggtggtcggcgcctgtagtaccagctgctcaggaggctgaggcaggagaatggcatgaacctgggaggcggagcttgcagtgagccgagattgcgccac

SEQ ID NO: 14567 - DNA, 201 bp, Artificial Sequence
  Description of Artificial Sequence: Synthetic polynucleotide
gagtgtagtggygtgatttyggtttattgtaagtttygtttttygggattaygttatttttttgttttagtttttygagtggttgggatttataggtgttygttaatatgttyggttaattttttgtatttttagtagagayggggttttatygtgttagttaggatggtttygatattttgatttygtgattygtttatt

SEQ ID NO: 14568 - DNA, 208 bp, Artificial Sequence
  Description of Artificial Sequence: Synthetic polynucleotide
ttggttaatatgatgaaattttgtttttattaaaaatataaaaaattagtygggygtggtggygggygtttgtagttttagttattygggagattgaggtygaatggygtgaattygggaggyggagtttgtagtgagtygagattatattattgtattttagtttgggygatagagygagattttgttttaaaaataaataaataaa

SEQ ID NO: 14569 - DNA, 201 bp, Artificial Sequence
  Description of Artificial Sequence: Synthetic polynucleotide
atayggtgaaatttygtttttattaaagtataaaaaattagtygggtatagtggtataggtttttagttttagttatttgggaggttgaggtaggagaatygtttgaattygggaggyggagggtgtagtgagttattgtaygttagtttgggtaatagagttagatttygttttaaaaaaaaaaaaaaaaaagaaagaaa

SEQ ID NO: 14570 - DNA, 201 bp, Artificial Sequence
  Description of Artificial Sequence: Synthetic polynucleotide
gtygaggtgggygaattatttgaggttaggagtttaagattagtttggttaatatggtgaaattttatttttattaaaaatataaaaattaatygggtatygtggtgygtgtttgtaattttagttattygggagattgaggtaggagaattgtttgaattttgtyggtagaggttgtaatgagttgagattgtattaygg

SEQ ID NO: 14571 - DNA, 201 bp, Artificial Sequence
  Description of Artificial Sequence: Synthetic polynucleotide
ttttggaggttatatttggataggagtyggtttttaattttagttaagagtttatagaggggtttttgtttaattgtatggagtttatggttgataggygyggyggtaggaygggaygggatyggatgggttgtgtatttgtttttatattagtattatattgttttgattattttagtttgtaagatgtttgaaatttat

SEQ ID NO: 14572 - DNA, 201 bp, Artificial Sequence
  Description of Artificial Sequence: Synthetic polynucleotide
aaaattataataaagtttttgtttaattatagattttgatttattggttaggtaggttgtttggtttttgatttgtatttagagggttttyggattttggygttgygtgggttagtgtttygggagtyggggatyggtattggtygtgttyggttgttgagtgtgttttattaattattatttygtttttttaggttaatg

SEQ ID NO: 14573 - DNA, 201 bp, Artificial Sequence
  Description of Artificial Sequence: Synthetic polynucleotide
gaggttttttttatttaggtaaagaagaaagaaggatggttttaggagtttatataatatggttaaaggtygggtagygtgtagtagaatgtaagatgagyggttaggttatagggygagattatgaaggattttttttyggttttaaatgttttttaagagtgtttttttattatttttttttttattttttaagaatag

SEQ ID NO: 14574 - DNA, 201 bp, Artificial Sequence
  Description of Artificial Sequence: Synthetic polynucleotide
tttttaagtagttgggattataggygttygttattaygttyggttaatttttaatatttttagtagagayggggttttattgtgttagttaggatggtttygattttttgatttygtgattygttygtttyggttttttaaagtgttgggattataggtttgagttattgygttyggtttttagtttttatatttgttaaa

SEQ ID NO: 14575 - DNA, 201 bp, Artificial Sequence
  Description of Artificial Sequence: Synthetic polynucleotide
ttaatataaaaattagttgttttagtygggygyggtggtttaagtttgtaattttagtattttgggaggtygaggygggyggattaygaggttaggagatygagattattttggttaatayggtgaaatttygtttttattaaaaatatataaaaaatgagtygggygyggtggtaggygtttgtagttttagttatttag

SEQ ID NO: 14576 - DNA, 201 bp, Artificial Sequence
  Description of Artificial Sequence: Synthetic polynucleotide
taaattttgttgttgtttattttatgggtttatattgtttttatgagttgtaatatttatygtaaaggtttgtaggtttatttttgagtyggtaagattaygaatttattagaagaaatttygaatatattygaatattagaaggaataaatttyggataygttatttttaagaattgtaatatttatygtaagggttygt

SEQ ID NO: 14577 - DNA, 201 bp, Artificial Sequence
  Description of Artificial Sequence: Synthetic polynucleotide
ttttgttttagtttttttagtagttgggattataggygttygttatygygttyggttaattttttgtatttttaatagaaayggggttttatygtggtttygattttttgatttygtgattygtygtttatttyggttttttaaagtgttgggattataggygtgagttatygygttyggtttttttttttatttttaata

SEQ ID NO: 14578 - DNA, 201 bp, Artificial Sequence
  Description of Artificial Sequence: Synthetic polynucleotide
ggggttttatygtgttagttaggatggtttygattttttgattttgtaataygttygtttyggttttttaaaatgttgggattataggygtgagttatygygtttagttggttttataggtatttatgtatattaatagtttttttttgagayggagtttygttttatttttaggttggagtgtaatggygttgttttgat

SEQ ID NO: 14579 - DNA, 235 bp, Artificial Sequence
  Description of Artificial Sequence: Synthetic polynucleotide
ttaattttttaggtgtygtttgttatttttttttttgattaggaaagggaattttttgattttttgtgttttyggagtgaggtaatgtttygttttgtttyggtttaygtagggtgygygtatttattgatttgygtttattgtttggtattttttagtgagatgaattyggtattttagatggaaatgtagaaattatttattttttgygtygttttttttgggagttgtagat

SEQ ID NO: 14580 - DNA, 201 bp, Artificial Sequence
  Description of Artificial Sequence: Synthetic polynucleotide
ggtagataaagatatatgattagggtyggtygyggtgatttatgtttgtaattttagtattttgggaggttaaggygaayggattaygaagttaggagatygagattattttggttaatatggtgaaattttgtttttattaaaaatataaaaaattagtygagygtggtggtgggygtttgtagygttagttattygggg

SEQ ID NO: 14581 - DNA, 201 bp, Artificial Sequence
  Description of Artificial Sequence: Synthetic polynucleotide
taggtgatttttgtatttttatttgaggtatygggtttattttattagggagtgttagatagtgggygygggttagtgggtgygtgtattatgygtaagtygaagtagggygaggtattgttttatttgggaagygtaaggggatagggagtttttttttygagttaaaaaaaggggtgatagaygtatttggataattag

SEQ ID NO: 14582 - DNA, 201 bp, Artificial Sequence
  Description of Artificial Sequence: Synthetic polynucleotide
agagatagaagttgttggagggygagaggaaygtattagtggaagaagatagaagyggttggttayggagagtatgttagtagaagaatatatttatagaygtyggttygttygygggtttttyggtaggttatygatyggtgggaygaggtggagtttgttttgggtagtaggaggatagttygggtatttagyggttta

SEQ ID NO: 14583 - DNA, 201 bp, Artificial Sequence
  Description of Artificial Sequence: Synthetic polynucleotide
tttatagaggtaggtaggtttttttgagttgtggtgggttttatttagttygagtttttyggttgttttgtttatttaagygagtttgggtaatggygggygttttttttttagtttygttgttgttttgtagtttgattttagattgttgtgttagtaattagtaagattyggtgggtataggatttttygagttaggtg

SEQ ID NO: 14584 - DNA, 201 bp, Artificial Sequence
  Description of Artificial Sequence: Synthetic polynucleotide
gtttttttttttagttaaagaaaggggtgatagaaggtatttggaaaatygggttatttttattagaatattgygttttttygaygggtttaaaaaayggygtatttggagattatattyggtatttggtttagagggttttaygtttatagagtttygttgattgttagtatagtagtttaagattaaattgtaaggygg

SEQ ID NO: 14585 - DNA, 201 bp, Artificial Sequence
  Description of Artificial Sequence: Synthetic polynucleotide
ygttygttatttttttttttgattyggaaagggaattttttgattttttgtgttttttaggtgaggtaatgtttygttttgtttyggttygygtayggtgygygtatttattggtttgygtttattgtttggtatttttttagtgagatgaattyggtattttagatggaaatgtagaaattattygttttttgygtygtt

SEQ ID NO: 14586 - DNA, 201 bp, Artificial Sequence
  Description of Artificial Sequence: Synthetic polynucleotide
gtaagtaaggggygtgttttagttttgtttgtgttagagtttttttatttttattatttggtaggtttagygttygggaataatgaygtaygtggataagyggagggtgagtaaggtgaagaggagttttattgagtaatagaatagtttagaggagattygyggtgggtagtttttttttgtagttagggtgttttgatg

SEQ ID NO: 14587 - DNA, 201 bp, Artificial Sequence
  Description of Artificial Sequence: Synthetic polynucleotide
ggtagattatttgaggttaggagttygagattagtttggttaatatggtgaaatttygtttttattaaaaatataaatattagtygggygtggtggtggtygtttgtaattttagttattygggaggttgaggtaggagaattgttggatttygggaggtagatgttgtagtgagttaagattatgttattgtattttagt

SEQ ID NO: 14588 - DNA, 201 bp, Artificial Sequence
  Description of Artificial Sequence: Synthetic polynucleotide
ttgtagtatatattattatttttttagtatattattattttttaattyggtttttatygttaataaagttgtyggttgtaggaatgagagagtggtagaaygatattttygttttattttttgggattttttagttgttggyggttttaagtttttaggagttayggtgttttttttttttagatgttagtgttaatagtg

SEQ ID NO: 14589 - DNA, 201 bp, Artificial Sequence
  Description of Artificial Sequence: Synthetic polynucleotide
ggttagaagayggtgagtggaaagttygggygygtggagagattttaagaaggggttgtttagttgtgaattttgtatttgtygttygtgttttatttggyggttttgaaattaggtttttatttggatttttgtgagttgtatattttyggttagttattttygttttagagggtttagatattggtagtgtyggaagac

SEQ ID NO: 14590 - DNA, 207 bp, Artificial Sequence
  Description of Artificial Sequence: Synthetic polynucleotide
gtttttgtgatttttgtagttagygaattagtatatttttggggttgaagttaygtgttaggtaygttagygttattagttygtttagggttagttttttygayggyggyggtagtaggtggatttygggtyggaatgtgttttttggagggtagagagttaggttagggggttgggtaggggatgagagagtttttttgttttggt

SEQ ID NO: 14591 - DNA, 201 bp, Artificial Sequence
  Description of Artificial Sequence: Synthetic polynucleotide
tttatggggtagttagaagggagatggtttttttttggagttggggtgttyggtagtttyggtttttttttgattgtttaggttaattttygttttttttygttggtttayggtttattggttttygggtgtttgttagygtgtttttttgttggggtgtttttatggatgattagygtttgtgttttttttttttgatgt

SEQ ID NO: 14592 - DNA, 201 bp, Artificial Sequence
  Description of Artificial Sequence: Synthetic polynucleotide
gaagaygggtgatttttgtatttttatttgaggtatyggttttattttattagggagtgttagatagtgggygtaggttagtgggtgygtgtatygtgygygaagtagggygaggtattgttttatttgggaagygtaaggggttagggagtttttttttygagttaaagaaaggggtgayggaygtatttggaaaatygg

SEQ ID NO: 14593 - DNA, 201 bp, Artificial Sequence
  Description of Artificial Sequence: Synthetic polynucleotide
ggggygtggttttttggagggaattagtgtggagatgttygtgtgtttggggygtggtttttyggagggagttagtgtggagatgttygtgtgtttggggygtggtttattagagggagttagtgtggagatgttygtgtgtttggggygtggttttttggagggaattagtgyggagatgtyggtgtgtttggggygtgg

SEQ ID NO: 14594 - DNA, 201 bp, Artificial Sequence
  Description of Artificial Sequence: Synthetic polynucleotide
gaygttttttattttttagatggggtggtggyggggtagagatattttttagtttttagatggggtygyggtttggtagaggtgttttttatattttagaygatgggtggtygggtagagaygttttttattttttagaygggatgayggttaggaagaggygttttttattttttagattgggyggtygggtagaggggt

SEQ ID NO: 14595 - DNA, 201 bp, Artificial Sequence
  Description of Artificial Sequence: Synthetic polynucleotide
gagtatagygtyggygggttggtattgttgggggattyggygtattttttatagttgttgtttygggtggtaagttttttattgttyggggttggtggggyggttagttgttyggagtgtggggttygttaaggttatgtttatttagaatttgttttggtttatygygagtagttttagttttygtttygygtttttttt

SEQ ID NO: 14596 - DNA, 201 bp, Artificial Sequence
  Description of Artificial Sequence: Synthetic polynucleotide
tttttgagtagttggggttataggtgtttattattaygttyggttaattttttgtatttttagtagagatggggttttatygtgttagttaggatggtttygattttttgaygttgtgatttatygtttyggtttttygaaatgttgggattataggtttgagttatygtattyggttatatttatttatttttaattaga

SEQ ID NO: 14597 - DNA, 201 bp, Artificial Sequence
  Description of Artificial Sequence: Synthetic polynucleotide
ttttttttttttttgattggtttygtttttattgtyggtttygtttttattgtyggttygggttttatttaygttggagttgttttatttaaggagattgygtagttggaaagttataygtgtgagtttagaggygggtttyggttgtagatttgttatggttttygaagtttttgtgygtttaggggtgttttttggtyg

SEQ ID NO: 14598 - DNA, 201 bp, Artificial Sequence
  Description of Artificial Sequence: Synthetic polynucleotide
gttagttagttattttgagatggagttttgttttgtygtttaggttgtagtgtagaatygtttttttggtttattgtaatttttatttttygggtttaagygataattttgttttagttttttaagtagttggaattatagaygtgtattattaygtttaattaatttttgtatttttagtagagatggggtttygttata

SEQ ID NO: 14599 - DNA, 201 bp, Artificial Sequence
  Description of Artificial Sequence: Synthetic polynucleotide
gyggttttttttgatttagatygtttttaaatatygaaygttgaattgggtygggygyggtggtttttatttgttattttagtattttgggaggtygaggygggyggattatgaggttaggagatygagattattttggttaatayggtgaaatttygtttttattaaaaatataaaaaaaaaaaattagtygggygtgat

SEQ ID NO: 14600 - DNA, 201 bp, Artificial Sequence
  Description of Artificial Sequence: Synthetic polynucleotide
ttatttttgttttttattttgggggttttatgatttyggagtttttaygttttggtatagagtttgttttttygggattgggtttyggtygagtagatatygtttagttgttttttgattagygttttttgttttgygtttggttggtatyggyggtttgttgagtttagtttggtatttygttggtatyggyggttygtt

SEQ ID NO: 14601 - DNA, 380 bp, Artificial Sequence
  Description of Artificial Sequence: Synthetic polynucleotide
ttttattaaaatataaaaaattggttgggggtggtggtaygtgtttgtagttttagttataygggaggttgaagtaggggaattgtttgaattygggaggyggagattgtagtgagtygagatygtgttattgtattttaatggtattttagtttgatgatagagygagatttygttttaaaaataataataaataaataaataaataaataaaaattagttgggygtggtggygtgtgtttgtagttttagttattygggagattgaggtaggagaatygygggaattygggaggyggaggttgtagtgagtygagatygygttattgttttgtagtatggagatagagttagatttygtttaaaaaaaaaaaaaaaaa

SEQ ID NO: 14602 - DNA, 201 bp, Artificial Sequence
  Description of Artificial Sequence: Synthetic polynucleotide
aggygggyggattaygaggttaggagatygagattattttggttaatayggtgaaatttygtttttattaaaaatataaaaaattagttgggygtggyggygggtatttttagttttagttatttgggaggttgaggtaggagaatggygtgaattygggaggyggagtttgtagtgagtygagatygygttattgtattt

SEQ ID NO: 14603 - DNA, 201 bp, Artificial Sequence
  Description of Artificial Sequence: Synthetic polynucleotide
aaaaattagttyggygtggtggtaygygtttgtaattttaattatttgggaggttgyggtaggtgaattatttgaagtygggaggtgaaggtygtagtaaygttgttttttgtattggatgaagtgttttttattaaatttttttatyggagagggtgggatttgygggttttttgggtggtttgatttygatattttgtg

SEQ ID NO: 14604 - DNA, 201 bp, Artificial Sequence
  Description of Artificial Sequence: Synthetic polynucleotide
ayggygaattgyggygattgtgaygtgtttttttatttttttttyggtggattttttttatttgttttttttttaatttttaataagtttttattatygaygaygtgagaygaygayggtatgggattttttatttygttagggttaatgaattttatattatgagttgtatgaggtatgagggagtttttaagggaggaa

SEQ ID NO: 14605 - DNA, 201 bp, Artificial Sequence
  Description of Artificial Sequence: Synthetic polynucleotide
gaygtagaagaygggtgatttttgtatttttatttgaggtatygggtttattttattagggagtgttagatagtgggtataggttagtgggtgygtatatygtgygtgagtygaagtagggtgaggtattgttttatttgggaagygtaaggggttagggagtttttttttygagttaaaggggtgayggaygtatttgga

SEQ ID NO: 14606 - DNA, 201 bp, Artificial Sequence
  Description of Artificial Sequence: Synthetic polynucleotide
taaataattagggataaagagtattatattgtygaatttattttatttttaattttttttttaaattttttataaaaaattagtygggtgtggtggygggygtttgtagttttagttatttagagattgaggtaggagaatggygtgaattygggaggaggagtttgtagtaagyggagatygygttattgtattatagtt

SEQ ID NO: 14607 - DNA, 201 bp, Artificial Sequence
  Description of Artificial Sequence: Synthetic polynucleotide
atttttgtgatttatattttattygtatattttttttttttttgaaaatttttaataaaaatttgttggttttayggtttaggggtattatagaatttatygatatgtgatgtttttttyggatgttyggttttaaaattttttttttttgtattttgtttttttattttttaatttggtygaygtttagggaaaatagaa

SEQ ID NO: 14608 - DNA, 201 bp, Artificial Sequence
  Description of Artificial Sequence: Synthetic polynucleotide
ttttggygaatttttattgttataattttaaaaattyggtttagggaggagtttattttttattttttatataggygatatatgtagaaatataattygtygttgtgtttgtgyggttaggattttttttttataygtaatgatttagttgattagtttaagatatgttyggtttttaygtttgtttgtaggggtattgtt

SEQ ID NO: 14609 - DNA, 201 bp, Artificial Sequence
  Description of Artificial Sequence: Synthetic polynucleotide
ttgggagtagaggtttttyggaaggtattatttttagagygtgtttttgagtaattttgaggatgggtttygggttattattgtgtgttggaaatagtagygtttaggttgtyggaggaggttggtttttttggtaggttttggttgtgtttagagttttgtgggttttggagataaggtttyggtttgaggtttttgggg

SEQ ID NO: 14610 - DNA, 201 bp, Artificial Sequence
  Description of Artificial Sequence: Synthetic polynucleotide
gtttgagtaggataaggattttagagtttaagagaattttgatgattagagaagggttttygaggttatyggggatgtayggtttgtatttyggtttttgygggataatggaggtttttttttttttttgtgttygggttygggtttttgtagatagatttttatatttagaggtgagaaattagatataattagatattt

SEQ ID NO: 14611 - DNA, 201 bp, Artificial Sequence
  Description of Artificial Sequence: Synthetic polynucleotide
ttatatgttaggttataaaataagtttttagaaatttaagaagattgaaattatattaattattttttaaaaaaaataggtggtygggygyggtggtttaygtttgtaattttagtattttgggaggtygagaygggyggattaygaggttaggagatygagattattttggttaatayggtgaaatttygtttttattaa

SEQ ID NO: 14612 - DNA, 568 bp, Artificial Sequence
  Description of Artificial Sequence: Synthetic polynucleotide
ttagtatatagatataaaaatgagaggtgatagygtgttggtagtttttatagttttygttttttttyggtattttttyggttttggygtttattttggtygygtttgaggagttttttagttygtygttgtattgtgggagtttttttttgggttggataaggttggagtyggtttttttagtttgygggtaggtgtggagagagaggygtgggygggaatygtggttgtaggttgygtttgygggttagttygagtttygggtgggygtgggtttggtaagtttygtattyggagyggttagtyggttygggtagtgaggagtttagtatttgggttagtagttgttgtgttygatttttygttgggttttagttgttttttygtygggtagggttygggatttgtagttttttatgtttgagtttttattttygtygtgygtttttgtgtagtttaagttttttygaygagygttaatttttgttttayggygtttagttttatygattgtttaagggttgaggagtgygggtatayggygtyggattggtaggtagttttattt

SEQ ID NO: 14613 - DNA, 201 bp, Artificial Sequence
  Description of Artificial Sequence: Synthetic polynucleotide
tttattaaaaatataaaaaattagttgggtattatggtgggtgtttgtagttttagttattygggaggttgaggtaggagaatggygtgaattygggaggyggagtttgtagtgagyggagatygygtygttgtattttagtttgggygatagagtaygagttygttttaaaaaaagaaaaaaaagaaagaaaagaaaaga

SEQ ID NO: 14614 - DNA, 201 bp, Artificial Sequence
  Description of Artificial Sequence: Synthetic polynucleotide
gggttggttaaggtyggagttggttttttttgtttgyggggaggtgtggagggagaggygtaggtgggaattagggttgtgtggggygtttgtgggtaagygtgagtttygggtgggagygggttyggtaaatttattttagggtgttttgttttttataaagaaaattttttttggggtttttatgggtttttttgggat

SEQ ID NO: 14615 - DNA, 201 bp, Artificial Sequence
  Description of Artificial Sequence: Synthetic polynucleotide
ttttaagtagttgggattataggtattygttattatgtttggttaattttttgtattttttagtatagatggggttttatygtgttaattaggatggtttygattttttgatttygtgatttgttygttttggttttttaaagtgtygggattataggygtgagttatygtgtttagttatatattatattttttttattt

SEQ ID NO: 14616 - DNA, 201 bp, Artificial Sequence
  Description of Artificial Sequence: Synthetic polynucleotide
aattatggggtgaattttgttatggggatatgtatttggggggaaggttgtgatgggaggggtattygggttaaataygggyggttgttagtgaagagttygtaagatagagtaggagttagggggaatagggagggaggggtattttttttttttttttttgagayggagttttattttgttttttaggttggagtgtag

SEQ ID NO: 14617 - DNA, 201 bp, Artificial Sequence
  Description of Artificial Sequence: Synthetic polynucleotide
tataggagtataaaagggttggyggttttgttygggtatattgttygtttttttatttattygtgtattttagtttattatttttgagttgggygtagtaygtggtttagagaaygggaagggatttaygagtgtttgatatatataattattgttgttggtgattatttttatttatgagtggygtatggatggggttag

SEQ ID NO: 14618 - DNA, 201 bp, Artificial Sequence
  Description of Artificial Sequence: Synthetic polynucleotide
taaaggtttgtttttgtatttaagtatttgagtttttaagagttagttttygggtttttttggagtaaggtttygttyggttttaygtatttgtttygttygtygtgatggtgagttygttgttgggttygtttttgttaattyggtttttggygtatatgyggatgttgtaggtggaggaagggtggatattaatgatgg

SEQ ID NO: 14619 - DNA, 201 bp, Artificial Sequence
  Description of Artificial Sequence: Synthetic polynucleotide
tttggttggttttgggatttgttttttggtggttaagtagtggttatgaaagtttagtygttgttatatttttgaggaatyggygtattttygtttatagyggtagttgggggtatttaygtggttyggggttgttttgatttggtagygtatgggggttgttgtttgggttttttagtgtgttatttgygygtttttygt

SEQ ID NO: 14620 - DNA, 201 bp, Artificial Sequence
  Description of Artificial Sequence: Synthetic polynucleotide
ttyggygtyggtatttattagygtggttagtttggtygaagtttygyggaagggygggattaggygtygtatygtygtgtttagggattggaattggygtygttygtaggttatgaggtttattatggagtttagygtygtattttgygagaggggtggatgtgggggtygtagggattttagayggttygggatygattt

SEQ ID NO: 14621 - DNA, 201 bp, Artificial Sequence
  Description of Artificial Sequence: Synthetic polynucleotide
tggttattttgggagtttgttgttgatgaattgtagtatggttatttgggtygtttattttgtatggttaygttgttyggttattgttgtaggtaygtttygtttygtttaattttttggttggtggggttattygggtgtttgtataygattttttttgagagggttagaggtyggtttaattatttgtaaataatgtta

SEQ ID NO: 14622 - DNA, 201 bp, Artificial Sequence
  Description of Artificial Sequence: Synthetic polynucleotide
ttagtatataggatatttatgygtgtttattattyggtataygggagatttaygygtgtttattgtygggtataggggagatttaygygtgtttattgttyggtataygagagatttaygygtgtttatygtttggtatagggagatttaygygtgtttattgttyggtataggggagatttaygygtgtttattgttygg

SEQ ID NO: 14623 - DNA, 201 bp, Artificial Sequence
  Description of Artificial Sequence: Synthetic polynucleotide
aggggaatagtaatagaagttttatttattaggtatttattgtgtgttaagtattgtgttaagggttttatagaataatagtataagaattttggtygggygtagtggtttatttttgtaattttagtattttgggaggtygaggtgggtggattaygaggttaggagttagagagattagtttagttaatatggtgaaat

SEQ ID NO: 14624 - DNA, 201 bp, Artificial Sequence
  Description of Artificial Sequence: Synthetic polynucleotide
tgtaygtatygtgygygagtygaagtagggygaggtattgttttattygggaagtaygaggggttagggagtttttatttttagttaaagaaaggggtgayggaygtatttggaaaatygggttatttttattygaatattgygttttttyggygggtttaaaaaayggygtattaygagattatattttatatttggttc

SEQ ID NO: 14625 - DNA, 201 bp, Artificial Sequence
  Description of Artificial Sequence: Synthetic polynucleotide
gttygttattaygttyggagaattttttgtatttttagtggagataggtttttattatgttagttaggatggtttygattttttgatttygtgatttgttygtttyggtttygtaaagtgttgggattataggygtgaggtatagygttyggtttygattgttttatttaaagtaatgaaagtatagttggttttaaagga

SEQ ID NO: 14626 - DNA, 201 bp, Artificial Sequence
  Description of Artificial Sequence: Synthetic polynucleotide
tttgyggttagttggattaggtggtyggtagygagayggaataagtagattaggttgagggtgaaggygtaggygattagtagtatggataagaggttgtygtttgttattttttttatygtttggtttagtatttatttattygtttgtagtaagtttagtagtattatttyggtygtygtygttattttattttgtygg

SEQ ID NO: 14627 - DNA, 201 bp, Artificial Sequence
  Description of Artificial Sequence: Synthetic polynucleotide
ttagattgttttttttttgagatagagtttygttttgttatttaggttagagtgyggaggygygattttagtttattgtaagtttygtttttygggtttaygttatttttttgttttagttttgygagtagttgggattataggygtttgttatygygtyggttaatttttttggtatttttagtagagatagggttttat

SEQ ID NO: 14628 - DNA, 201 bp, Artificial Sequence
  Description of Artificial Sequence: Synthetic polynucleotide
atagtttattaaaaatataaaaaaaaaaaaaaaaaaatttgtygggtgtggtggtgtgtgtttgtaattttagttatttgggaggttgaggtaagagaatygattgaattygggaggtagagattgtagtgagtttagattatgttattgtattttagtttggataagagtgagattttattttaaaaataaaaataaaaa

SEQ ID NO: 14629 - DNA, 201 bp, Artificial Sequence
  Description of Artificial Sequence: Synthetic polynucleotide
tgtttttttttgttttgagatggagttttattttattgtttaggttggagtgtagtggtgttattttggtttattgtaatttttatttttygggttttagygatttttttgttttagttttttaagtagttgggattgtaggtgtttataattaygttyggttaatttttgtgtttttagtagagtyggagttttattatg

SEQ ID NO: 14630 - DNA, 201 bp, Artificial Sequence
  Description of Artificial Sequence: Synthetic polynucleotide
tgtttgttattaagtttagttaatttttgtatttttagtagagayggggttttattgtgttggttaggttggtttygaatttttgatttygtgattygttygttttggttttttaaagtgttaggattataagtgtgagttatygygttyggttttttaaatggtatttttgattttttttttttagtttttaaagtaggt

SEQ ID NO: 14631 - DNA, 201 bp, Artificial Sequence
  Description of Artificial Sequence: Synthetic polynucleotide
gttaaggtgggyggattatttgaggttaggagttygagattagtttggttaatatggtgaaattttatttttattaaaaatatggaaaaaattagtygggyggggttygagtttgtaattttagttatttgggagttgaggygygagaatygtttgaagtygggagggggaggttgtaggagtagaggttgtgttattgta

SEQ ID NO: 14632 - DNA, 201 bp, Artificial Sequence
  Description of Artificial Sequence: Synthetic polynucleotide
ggtttgtatggtgygtgattatttttagtggaagttttaatatgggtgtggtttagttttttagggttttttaaggtagaggtggttygggtttttgtagygattttataatatattttaattgtagayggtggagattgygggttgtttttyggtttaagyggttttggggttttygttttgygyggagttattygtgtt

SEQ ID NO: 14633 - DNA, 201 bp, Artificial Sequence
  Description of Artificial Sequence: Synthetic polynucleotide
gygttttgggttattgagagaagtgaaatattgtagatayggtagaggtgtttttttttttttttygtttttagatgtggtttttataygtaggttgatgygttttttttttatttaygtttgttyggttttgttatatatgtygttgtgttgtyggttttgaatgtgtatgagyggttygtgttggggttagyggaggtt

SEQ ID NO: 14634 - DNA, 234 bp, Artificial Sequence
  Description of Artificial Sequence: Synthetic polynucleotide
aggggttatatttatggatttttttttttttggtaggaagatgagtgattatattttygttattattgaattgagygttttgtttgttyggygttagtatygtttgtattattatttygattttatttattatygttyggyggatgggyggaggtttyggtaggtttgtgatatggtgtattattttattattgaagttatttaggaayggyggygggtattgygttagtaggg

SEQ ID NO: 14635 - DNA, 201 bp, Artificial Sequence
  Description of Artificial Sequence: Synthetic polynucleotide
ggggttttttgtttttagtatygttagtttaggtgtgttttttatggygtgatgygtttgtagatttggaaatattataggatttaggtattttayggagygttygttttgtgttagttttagtttagygttttttagatatygtttgatttttyggaggtagttatygatattgygtttattgtatagatgagaaagttg

SEQ ID NO: 14636 - DNA, 201 bp, Artificial Sequence
  Description of Artificial Sequence: Synthetic polynucleotide
tttttagtgagatgaattyggtattttagatggaaatgtagaaattattygttttttgygtygtttaygttgggagttgtagatyggagttgtttttattyggttattttggttttttttttttgttttttttttgagatagtgtttttttttatttttgttatttaggttgtagtgtagtggygyggtttgtgtttattg

SEQ ID NO: 14637 - DNA, 201 bp, Artificial Sequence
  Description of Artificial Sequence: Synthetic polynucleotide
taattttattttgtttttgagatagagtttygttttgtygtttaggttggagtgtagtggygtaatttyggtttattgtaagtttygtttttygggtttaygttattygtttgttttagttttttgaataattgggattataggygttygttattaygttyggttaaatttttgtatttttagtagagayggggttttatc

SEQ ID NO: 14638 - DNA, 201 bp, Artificial Sequence
  Description of Artificial Sequence: Synthetic polynucleotide
atttttagggttgyggatggtagaattaaaagagttaattagtaagtagaatygtttttttyggggttttaaggtttgagtattttttttggggtgttatygtatttttttyggggtgatatgtttggtttagttgtaagttttgtttagaatttgtttgtgtatyggtgtttggaatagttagttggattttatatttat

SEQ ID NO: 14639 - DNA, 201 bp, Artificial Sequence
  Description of Artificial Sequence: Synthetic polynucleotide
ggtttttgtagggagtttatattagtagttttttattttgaggagataygygggtttttttttygaagttygtttaggaggtagatggagygattygattyggaggataggagggtgtttaggggttttggygttatagtttttataggatgattttggagygtttttggatttygagttgttttggttaaggagtygtat

SEQ ID NO: 14640 - DNA, 201 bp, Artificial Sequence
  Description of Artificial Sequence: Synthetic polynucleotide
tatatataggygtggatatttatatggttttyggtagtgttgtaggaggttagtatagagaygtgttgaggagtttgagatgttygtttttttgggttatygygtgtaaaggttgttttygttgtggatttttatatgtgtgatatatatgaataggygaaayggataygtayggtttttatataygtgagttgggttttt

SEQ ID NO: 14641 - DNA, 201 bp, Artificial Sequence
  Description of Artificial Sequence: Synthetic polynucleotide
tttttgtgaaggtattaagtayggtagaygtttttatatygtyggggttygtttttttgtggaygggaagtgggaaygtgaygtggaygtgaygtgggaaygtaaygtgaygtgaygtgaygtgaygtggtatggygygaggatagygyggygggagyggygttttagatttagtagggagggagaygaaaggyggatgga

SEQ ID NO: 14642 - DNA, 201 bp, Artificial Sequence
  Description of Artificial Sequence: Synthetic polynucleotide
gttgggygtggtggtaygtgtttgtagttttagttatttaggaggttgaggtaggagaattttttgaattygggaygtagaggttgtagtgagttgagatygygttattgtattttagtttggtaatagagtgagatttyggtttaaaaaaaaaaaaaaagaaaaaaaaaaaaaaaagaaggagttgaggttttaagaatt

SEQ ID NO: 14643 - DNA, 201 bp, Artificial Sequence
  Description of Artificial Sequence: Synthetic polynucleotide
ttgtattttgtgggtaggggatattttttttagtggttggtgatgattgtgattttatttgtygagttttgtgggagtttyggtagtttttygtaattgtyggttggttgttattgttttagygtttgttttttgattggttagtaaattayggtggtagatagaaaaaagatagtttttttttttagggttgttttataa

SEQ ID NO: 14644 - DNA, 201 bp, Artificial Sequence
  Description of Artificial Sequence: Synthetic polynucleotide
ttttgttggygtattttgttggygtattttgttggygtattttgttggygtattttgttggygtattttgttggygtattttgttggygtattttgttggygtaagttgygttttgggattgggtttgaaaagggaggagttatttattttaagtttttaggttyggggagaattttatagtaagttttttgggagtttga

SEQ ID NO: 14645 - DNA, 686 bp, Artificial Sequence
  Description of Artificial Sequence: Synthetic polynucleotide
gtggtatttgtaggtttttaggattaggtagaggatttagtttttttaggattggggtttyggygttgygttttaggggaggtygaygggggttgggaggygtttagggygggaatttagygtaygggtgaggattttaaaaagtaaggggtaggatgagttaataaggttttgagtaggaaaattatgygataggaagtgtatatattgttttatagtagaaagatyggggaygggattagtttttaagygattttaaatttaaaaggaagtaatttttagatttttatgggygttttaatttgttttgggtgaaggaagataggtaagaatttttaggtttgtgaggattttaygttttagggatagaagtgttagggatttgggaagtgtagatttaatataaggtagagtaaaatttaygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyggggtygggattagatttgtgtattttttygtttygtatttagygtttttgtttttygggtgtttggaggtgagagyggttaggaaggttgaggtatgat

SEQ ID NO: 14646 - DNA, 201 bp, Artificial Sequence
  Description of Artificial Sequence: Synthetic polynucleotide
gttagagtgtagtggtgygatttyggtttattgtaagtttygtttttygggtttaygttatttttttgttttagtttttttagtagttgggataggggtaygtygttaygttyggttagtttttgtatttttagtagagayggggttttattatattagttaggayggtttygattttttgatttygtgatttgttagttt

SEQ ID NO: 14647 - DNA, 201 bp, Artificial Sequence
  Description of Artificial Sequence: Synthetic polynucleotide
gttagagattttgtttttaaaagtaaaaaagaaaaaaaaagtttttttttaagttattatatattttgaataattaatattgaaaattgttggtygggygyggtggtttaygtttgtaattttagtattttgggaggtygaggyggggyggattaygagattagtagaayggygtgaattyggaaggyggagtttgtagtg

SEQ ID NO: 14648 - DNA, 201 bp, Artificial Sequence
  Description of Artificial Sequence: Synthetic polynucleotide
ttgtatttttatttgaggtatygggtttattttattagggagtgttagatagtgggygtaggttagtgggtgygtgtatygtgtgygagtygaagtagggygaggtattgttttatttgggaagygtaaggggttagggagttttttttttgagttaaagaaaggggtgayggaygtattttgaaaatygggttattttta

SEQ ID NO: 14649 - DNA, 201 bp, Artificial Sequence
  Description of Artificial Sequence: Synthetic polynucleotide
aygtatttattgatttgygtttattgtttggtagtttttagtgagatgaattyggtattttagttggaaatgtagaaattattattttttgtgtygtttaygttgggagttgtagatyggagttgtttttattyggttatgttggttttttttttggatataattatttttgtatttatttaatttttatttttatggaat

SEQ ID NO: 14650 - DNA, 201 bp, Artificial Sequence
  Description of Artificial Sequence: Synthetic polynucleotide
tttttatgtgattattgtttgtttgttagygttagttttttttgattttaaattataagtggaagaaagtaygttagaaatttatagaattggttyggygyggtggtttaggtttgtaattttagtattttgggaggtygaggtaggyggattaygaggttaggagatygagattattttggttaatagggtgaaatttyg

SEQ ID NO: 14651 - DNA, 201 bp, Artificial Sequence
  Description of Artificial Sequence: Synthetic polynucleotide
aagttttttttttttttttttttttttttttttgagayggagttttattttttygtttaagttggattgtagtggygttatttyggtttattgtaagtttygttttttgggtttatgttatttttttgttttagtttttygagtagttgggattataggygtttattattaygttyggttaattttttgtatttttagtag

SEQ ID NO: 14652 - DNA, 201 bp, Artificial Sequence
  Description of Artificial Sequence: Synthetic polynucleotide
ygtttggtgtatgttgtggagggygtgggtaatggygtatatygtattaattataaattgtattttgtttttttgttygtaggtggagtttyggtygatgygtttttygtttgttttagggatgtttagagaaagtgtgttyggtttttatgtatygaattyggtttttygttttttttttttttatttttattatttttt

SEQ ID NO: 14653 - DNA, 201 bp, Artificial Sequence
  Description of Artificial Sequence: Synthetic polynucleotide
gattttagggggttttattttagyggttttttttattttttttgtagagaaaaaagagtgtyggygggattatygtttatygtgtgtttaggaggygtttygtaatatggtgtattttaatgtgatttgygatggttgtaatgggtttgtggtaggaattygttataagtgtagygtttgtttagattaygatttgtgtag

SEQ ID NO: 14654 - DNA, 201 bp, Artificial Sequence
  Description of Artificial Sequence: Synthetic polynucleotide
ggtattttatttatttagagatagagtttygttgygaygtttaggttggagtgtatggygtaattttggtttattgtaggtttygtttttygggttttagygatttttttgttttagtttttygagtagttggggttatagttatgtgttattaygtygggttaatttttgtatttttagtagagatagggtttttttata

SEQ ID NO: 14655 - DNA, 201 bp, Artificial Sequence
  Description of Artificial Sequence: Synthetic polynucleotide
ttattatgtttaattaattttttttatttgtagtagagatagggttttattgtgttagttaggatggtttygattttttgattttgtgattygygtgtttyggttttttaaagtgttgggattataggygtgagttatygygttyggtttgtaaatattttttgygttttagtgggttatgtttttattttgttgattgtt

SEQ ID NO: 14656 - DNA, 227 bp, Artificial Sequence
  Description of Artificial Sequence: Synthetic polynucleotide
ttagttttttgagtagttggaattataggtgttygttattaygttyggtttattttttgtatttttagtagagayggggttttattatgttagttaggatygttttgattttttgatttygtgattygtyggtttyggttttttaaagtgttgggattataggygtgagttattaygtttagttttagaaattgaaatgtatattattaagtgaaagaagttaattt

SEQ ID NO: 14657 - DNA, 201 bp, Artificial Sequence
  Description of Artificial Sequence: Synthetic polynucleotide
tttttttttagttttgttgttattttgtagtttgattttagattgttgtgttagtaattagygagatttygagttaggtgtgggatataatttygtggtgygtygttttttaagtyggtyggaaaagygtaatattygggtgggagtgattygattttttaggtgygttygttatttttttttttgattyggaaagggaat

SEQ ID NO: 14658 - DNA, 201 bp, Artificial Sequence
  Description of Artificial Sequence: Synthetic polynucleotide
aggtgygtttgttatttttttttttgattyggaaagggaattttttgattttttgygttttttaagtgaggtaatgtttttttttgtttyggttygygtayggtgtatgtttttattgatttgygtttattgtttggtttttttaagtgagatgaattyggtattttagatggaaatgtagaaattattygttttttgygt

SEQ ID NO: 14659 - DNA, 201 bp, Artificial Sequence
  Description of Artificial Sequence: Synthetic polynucleotide
tgtttttttgttttagtgtttatattgtaaaaaagtgttttttttatygggygyggtggtttaygtttgtaattttagtattttgggaggtagaggygggyggattaygaggttaggagatygaaattattttggttaatayggtgaaatttygtttgtattgtgaatataaaaaattagtygggygtggtggygggtgtt

SEQ ID NO: 14660 - DNA, 201 bp, Artificial Sequence
  Description of Artificial Sequence: Synthetic polynucleotide
gtygggygtggtggygggtatttgtagttttagttattygggaggttgaggtaggagaatggggtgaattygggaggyggagtttgtagtgagtygagatygygttattgtattttagtttgggtgatagagygagattttattttaaaaaaaaataatattaggattgaagtttgttttttaatttttagtgatayggtt

SEQ ID NO: 14661 - DNA, 201 bp, Artificial Sequence
  Description of Artificial Sequence: Synthetic polynucleotide
tgaataagaaagggttattatattttattttgaaatggtttttggagaaagaatggaagtaaattgtataagtgggygtttatttttttttattyggttayggttatygtggtgttyggttaggtttttggtgaygtgaggtaaattttttygttggtaaattagtttatatattttttttattgtagayggttatttaga

SEQ ID NO: 14662 - DNA, 201 bp, Artificial Sequence
  Description of Artificial Sequence: Synthetic polynucleotide
ttaagtatttttttgtgattygtttagaggaatttttggtagtggggatggygttatttttatttgagagatgaggagattgaggtttagaggggggaygyggtttgttygagttatattgattgagaggggtagatttggattygtttgtagtttaagtttttagagattttggtgtggtttgtygggtagttagtttgt

SEQ ID NO: 14663 - DNA, 201 bp, Artificial Sequence
  Description of Artificial Sequence: Synthetic polynucleotide
gtgtgattttggaggggtaagaattatttyggtagttatgggggagtttaygagtgtttgataagaggttaygtttttttgggattttttagaaagttagyggaggggtyggggatagtagttgttttgggtttaaggtgagtagtattgtygtttttgaggatggygtgtaggtgaaggtattgtygattttaggttggg

SEQ ID NO: 14664 - DNA, 201 bp, Artificial Sequence
  Description of Artificial Sequence: Synthetic polynucleotide
ttyggatatttaggttattttygaattttaaggtttttaatygtagttataygtatagaggtttttttgttatgtggggtaatayggttatagggtaagayggttaygggttttagatatttttgggttattattttgtttatygtaggtggatatagttatggaatggaagtaatttttttgattatttayggtagtttt

SEQ ID NO: 14665 - DNA, 201 bp, Artificial Sequence
  Description of Artificial Sequence: Synthetic polynucleotide
gattttttygagtttgtygggagatagttaygttaatggttataaygggtatagygtttaggaaygtagtaatttagttagtygttagttttttttttggygygggtattatttaaygygtttatttggggtttagatgygataaattggtygagggattttgggttttggttgggaygagygtagtaaatttgtygttat

SEQ ID NO: 14666 - DNA, 201 bp, Artificial Sequence
  Description of Artificial Sequence: Synthetic polynucleotide
ttttgaatagtagtaggtagtagagttttagggagagtaggttttygtggtgtagtattayggttttgtgttttatttyggagaagttgayggagatgtgygtttyggggatgggttttaggattagttttttygyggtttggtygttgttygggagyggttgtyggyggatggtgtagtgtagaggtaggatgtyggggg

SEQ ID NO: 14667 - DNA, 201 bp, Artificial Sequence
  Description of Artificial Sequence: Synthetic polynucleotide
atagggttttattttgttagttaggatggtttygattttttgatttygtgattygttagtttyggttttttaaagtgttgggattataggygtgagttatygtattgggttggtagttattttttttaagtagtagttttattttttagtataaattaatgttgtagtttttaaattatttgttgaagtgtttttgaattt

SEQ ID NO: 14668 - DNA, 201 bp, Artificial Sequence
  Description of Artificial Sequence: Synthetic polynucleotide
ttttttttttttttttgagatagaattttgttttgttgtttaggttggagtatagtggtgygatattagtttattgtaaattttatttttygggtttaagygatttttttgttttagttttttgagtatttgggattatagggagtgtttttatatttggttaattttttgtatttttagtagagatagggttttatygtg

SEQ ID NO: 14669 - DNA, 201 bp, Artificial Sequence
  Description of Artificial Sequence: Synthetic polynucleotide
aatagttgggygyggtggtttatatttgtaattttagtattttgggaggttgaggygggtagattaygaggttaggaaatygagattattttggttagtayggtgaaatttygtttttattaaaaatataaaaaaaattagtygggygttgtggyggaygtttgtagttttagttatttttaaggttgaggtaggagaatg

SEQ ID NO: 14670 - DNA, 201 bp, Artificial Sequence
  Description of Artificial Sequence: Synthetic polynucleotide
ttgattyggaaagggaattttttgattttttgygttttttaagtgaggtaatgttttgttttgttttggttggygtayggtgygygtatttattgatttgygtttattgtttggttttttttagtgagatgaattyggtattttagatggaaatgtagaaattattygttttttgtatygtttaygttgggagttgtagat

SEQ ID NO: 14671 - DNA, 201 bp, Artificial Sequence
  Description of Artificial Sequence: Synthetic polynucleotide
tttttattttgttttttagatagaatttygttgtgttatttaggttggagtgtagtggygtgattttggtttattgtaatttttgtttttygggtttaygygatttttttgttttagttttttaagtagttgggattgtaggtgtgtattattatgtttatattaagtttttgtatttttagtagagatggggttttgtta

SEQ ID NO: 14672 - DNA, 201 bp, Artificial Sequence
  Description of Artificial Sequence: Synthetic polynucleotide
tagtgaaatttygtttttattaaaaatataaaaaattagttyggygtggtgaagggtatttgtagtygtagttatttaggaggttgaggtaggagaatggygtgaattygggaggtggagtttgtagtgaatygagattaygttattgtattttagtttgggygatagagtgagattttgttttaaagaaatagaagattt

SEQ ID NO: 14673 - DNA, 201 bp, Artificial Sequence
  Description of Artificial Sequence: Synthetic polynucleotide
ttttgtgaaaaataaaaaaaataagtygggygyggtggtttaygtttgtaattttagtattttgggaggtygaagtaggtagattaygaggttaggagatygagattattttggttaaygyggtgaaatttygtttttattaaaaatataaaatattagtygggygtagtggygggygtttgtagttttagttattyggga

SEQ ID NO: 14674 - DNA, 201 bp, Artificial Sequence
  Description of Artificial Sequence: Synthetic polynucleotide
gagttaaagtgataygtttgtttgggttttttaaagtgttggaattatagatttgagttatygggtttagtttaattattttttttagtttgagtatgagygtyggaagaaaagtttttatttgtatttattttttttagatatagggtttttttttgttatttaggttggagagtagtggygtaattttygttyggttta

SEQ ID NO: 14675 - DNA, 201 bp, Artificial Sequence
  Description of Artificial Sequence: Synthetic polynucleotide
ggagtatgaggtaggagagttatttgaattygggaggtagaggttgttgtgagtygagattatatttttttattttagtttgagtggtagagtaagatttygttttaaaaaaaaaaaaaaaaagttgggggaaggagagaaaaatagagagtttagtggggtaattttttatttagtttttgttatttgttattgttttag

SEQ ID NO: 14676 - DNA, 201 bp, Artificial Sequence
  Description of Artificial Sequence: Synthetic polynucleotide
atatttggtttttgggatttgtatatttttgttttttttgggtggaaagayggtttttttgattagggtttttttgtgttttagagggtaygttttttttygtaagtgtgagtygtatattagtgagtatgtgtttttatttttagggatatyggttattaggtttggggttagatggtaggattttygttttttttttta

SEQ ID NO: 14677 - DNA, 201 bp, Artificial Sequence
  Description of Artificial Sequence: Synthetic polynucleotide
ttataggygttygttattaygttyggttaattttttgtgttttgtttagtagagayggggttttatygtattagttaggatggtttygatttgttgatttygtgattygttygtttyggttttttaaagtgttgggattataggygtgagttattttgygttyggtttttttatttttatattttaaattagagatgattt

SEQ ID NO: 14678 - DNA, 217 bp, Artificial Sequence
  Description of Artificial Sequence: Synthetic polynucleotide
tataggygttttttattaygttyggttaattttttgtatttttagtagagayggggttttatygygttagttaggatggtttygattttttgattgagatygygtttttttgatygygttyggtygattttttttttttttttatttgttttttttttttttattattattaaaagtttattgttttatatttttttttttttaattttatttaaaa

SEQ ID NO: 14679 - DNA, 217 bp, Artificial Sequence
  Description of Artificial Sequence: Synthetic polynucleotide
ggtttatagtttttagtttgagygaygtagaagaygggtgatttttgtatttttatttgaggtatygggtttattttattagggagtgttagatagtgggygtaggttagtgagtgygtgtatygtgygygagtygaagtagggygaggtattgttttatttgggaagggtaaggggttagggagtttttttttttagttaaagaaaggggtgaygg

SEQ ID NO: 14680 - DNA, 201 bp, Artificial Sequence
  Description of Artificial Sequence: Synthetic polynucleotide
gttygttattaygttyggttaaatttttgtatttttagtagagatggggttttattttgttaattaggatggtgtygattttttgatttygtgattygttygttttggttttttaaagtgtygggattataggygtgagttattgygttyggtttggaaattgttttttatgtagttgatttattttaatttttattagta

SEQ ID NO: 14681 - DNA, 201 bp, Artificial Sequence
  Description of Artificial Sequence: Synthetic polynucleotide
tatatgattttgaataagttttgaattatttatatgtgatttttyggttttatatgaggtagaatagtayggtgtggatygggaattttgaygtgggagtygaaagatggggaggttgtgggtayggttttyggagtttygggattgagatatgtaggtattttagaygggtttgttgttataataagtgggaaattttta

SEQ ID NO: 14682 - DNA, 201 bp, Artificial Sequence
  Description of Artificial Sequence: Synthetic polynucleotide
tttagagaagattyggtagtttttttagttttyggtttttgttttygttttttttttttttgtttttaggttttttttttgtagttttttagttttttatygygttttgygtttttggttttttttttttttagtgttttttttatttggygtygttyggtygtaattttggtttttttggggaagaggttyggattttat

SEQ ID NO: 14683 - DNA, 201 bp, Artificial Sequence
  Description of Artificial Sequence: Synthetic polynucleotide
tgtttttatattggaaaaatttaaatatttttaagagtttgattattggtygggygyggtggtttaaygtttgtaattttagtattttgggaggtygaggyggtyggattataaggttaggagatygtgattattttggttaatayggtgaaatttygattttattaaaaaaatataaaaaaattagtygggygyggtggc

SEQ ID NO: 14684 - DNA, 201 bp, Artificial Sequence
  Description of Artificial Sequence: Synthetic polynucleotide
gatttggttgtttagaagygtgtgttatttyggattgagttaagatggtygaataggaatagtttyggtttatagtttttattgtgagygaygtagaagaygggtgatttttgtatttttatttgaggtatygggtttattttattagggagtgttagatagtgggtgtaggttagtgggtgygygtatygtgygtgagtt

SEQ ID NO: 14685 - DNA, 201 bp, Artificial Sequence
  Description of Artificial Sequence: Synthetic polynucleotide
ttttggtygggygtygtggtttaygtttgtaattttagtgagaggtgatagtatgttggtagttttygtagtttttttttattagygygattttygggtgygygtgggttgggttggttygtatttggagyggttagtagtttygggtagtgaggggtttagtatttgggttagtagttgttgtgttygatttttygttag

SEQ ID NO: 14686 - DNA, 201 bp, Artificial Sequence
  Description of Artificial Sequence: Synthetic polynucleotide
tgtggtygggygyggtggtttatttttgtaattttagaattttgggaggtygaggygggyggattaygagattagtagattgagattattttggttaatayggtgaaatttygtttttattaaaaatatagaaaaagtagtygggygtggtggygggtatttgtagttttagttataggttgaggtagaagaatggygtga

SEQ ID NO: 14687 - DNA, 201 bp, Artificial Sequence
  Description of Artificial Sequence: Synthetic polynucleotide
tttyggttttttaaagtgttggggttataggygtgagttatygygttyggttagtygtttttattaaaaatataaaaaattagtttggygtggtggygggygtttgtagttttagttatttyggaggttgaggtaggggaattgtttgaatttatgaggyggaggttttaagtygaggtygtgttattgtattttagtttg

SEQ ID NO: 14688 - DNA, 201 bp, Artificial Sequence
  Description of Artificial Sequence: Synthetic polynucleotide
ggttggagtgtagtggygtgatttyggttygttataatttttattttttagtagtttgttttggttttttaaagtgtygagattgtagtttttgttyggtygttatttygtttgagaagtgaggagygtttttgtttggtygttattttatttaggaagtgaggagygttttttttyggtygttattttatttgggaagtg

SEQ ID NO: 14689 - DNA, 201 bp, Artificial Sequence
  Description of Artificial Sequence: Synthetic polynucleotide
gttttagttgttttttygyggggtagggttygggatttgtagttygttatgtttgagttttttatttttttygtgggtttttgtgyggttygagttttttygaygagygttattttttgttttayggtatttagttttattgattatttaagggttgaggagtgygggygtatagtatygggattggtaggtagttttatt

SEQ ID NO: 14690 - DNA, 286 bp, Artificial Sequence
  Description of Artificial Sequence: Synthetic polynucleotide
gaagaygggtgatttttgtatttttatttgaggtatygggtttattttattagggagtgttagatagtgggygtaggttagtgggtgygygtatygtgygygagtygaagtagggygaggtattgttttatttgggaagygtaaggggttagagagtttttttttygagttaaataaatgggtgayggaygtatttggaaaatygggttatttttattygattattgygttttttagatyggtttaaaaaayggtgtattaygagattatattttatatttggttc

SEQ ID NO: 14691 - DNA, 201 bp, Artificial Sequence
  Description of Artificial Sequence: Synthetic polynucleotide
gttttagttgtttttttgyggggtagggtttgggatttgtagtttgttatgtgtgagtttttttttattgttttaggtttttgtgtagtaggagttttttygaygagtatygttttttgttttatggtattyggttttatygattgtggaayggttgaggagygtgggtataaggtatgggattggtaggtagttttgttt

SEQ ID NO: 14692 - DNA, 201 bp, Artificial Sequence
  Description of Artificial Sequence: Synthetic polynucleotide
ggagtgtaatggtattatttyggtttattgtaattttygtttttygggtttaggygatttttttgttttagtttttygagtatttgggattataggygygygtttttaygtttaattaatttttgtatttttagtagagayggagttttattatgttggttaggttygtttygaatttttgatttygtgatttattygttt

SEQ ID NO: 14693 - DNA, 201 bp, Artificial Sequence
  Description of Artificial Sequence: Synthetic polynucleotide
ttttygttatttttttttttgattyggaaagggaattttttgattttttgygtttttygagtgaggtaatgtttygttttgtttyggttygygtatattgygtatatttattgatttgygtttattgtttggtattttttagtgagatgaattyggtattttagatggaaatgtagaaattattygttttttgygtygttt

SEQ ID NO: 14694 - DNA, 201 bp, Artificial Sequence
  Description of Artificial Sequence: Synthetic polynucleotide
gaygtagaagaygggtgatttttgtatttttatttgaggtatygggtttattttattagggagtgttagatagtgggygtaggttygtgggtgtatgtatygtgtgygagttgaagtagggygaggtattgttttatttyggaagygtagggggttagggagtttttttttttagttaaagaaaggggtgatagayggtat

SEQ ID NO: 14695 - DNA, 201 bp, Artificial Sequence
  Description of Artificial Sequence: Synthetic polynucleotide
tttagttaattttttttatatttttaatagagatagggttttattatgttggttaggatagttttgattttttgatttygtgattygttygtttyggtttygtaaagtgttgggattataggygtgagttatygtattyggttggaagtatatattttaatagttttatatagtagttgttgttagaatttaaatgaagat

SEQ ID NO: 14696 - DNA, 201 bp, Artificial Sequence
  Description of Artificial Sequence: Synthetic polynucleotide
tagaagaygggtgatttttgtatttttatttgaggtatygggtttattttattagggagtgttagatagtgggygtaggttagtgtgtgtgygtatygtgygygagtygaagtagggygaggtattgttttatttgggaagygtaaggggttagggagttttttttttgagttagggaaaggggtgayggatggtatttgg

SEQ ID NO: 14697 - DNA, 201 bp, Artificial Sequence
  Description of Artificial Sequence: Synthetic polynucleotide
ttggtagggtyggtyggttgtttttagtgyggggtttgttaagtttaygtttattyggaattttagttggttygtaagtattatgtatagtttgggttttygtttaygtttttttatttatatttttttgtaagttgagggagygggttttggttttggttagtttagaaaggggtttttatagtgtagyggtgggttgaa

SEQ ID NO: 14698 - DNA, 201 bp, Artificial Sequence
  Description of Artificial Sequence: Synthetic polynucleotide
tttgagattttygtagtttyggggtttgagttgaggggttatyggtagtgtygtgggagttaggttgttttttyggaagttaggttgtttttgagtagagyggaggttttatygtttttyggggggtayggtggtagtttttaggttgtattggggttggatgagttgggggtggagtataaggggttagttttttttttt

SEQ ID NO: 14699 - DNA, 201 bp, Artificial Sequence
  Description of Artificial Sequence: Synthetic polynucleotide
aaatttttygtttgtagggggygggtggggaggtggaggaggggttgggttaaaygttgggggtgtgattyggggttgygggttttygggttttagttttygggtttgtygagtgggygagtggggtgttttattttttgyggttttttttyggtttttatagaatatggagaaggygattttgtygtyggtgaygtttat

SEQ ID NO: 14700 - DNA, 201 bp, Artificial Sequence
  Description of Artificial Sequence: Synthetic polynucleotide
gggygtttgtagttttagttattygggaggttgaggtaggagaatggtatgaattygggaggyggagtttgtagtgagtygagatygygttattgtatttyggtttgggygatagagygagatttygttaaaaaaaaaaaaaaaaagtagttttgtaagattaggtgtttggtagataggtatatttagtaaagttataat

SEQ ID NO: 14701 - DNA, 210 bp, Artificial Sequence
  Description of Artificial Sequence: Synthetic polynucleotide
ttattaaaaatataaaaaaattagtttggygyggtggygggygtttttagttttagttgttygggaggttgaggtaggagaatggygtgaattygggaggyggagtttgyggtgagtygagattttgttatagtattttagttygggygatagagtgagatttygttttagaaaaaaaaaaaaaaaaaaaaaagaagtgggaatttagaa

SEQ ID NO: 14702 - DNA, 201 bp, Artificial Sequence
  Description of Artificial Sequence: Synthetic polynucleotide
tttygggtttaygttattttttygttttagtttttygagtagttgggattataggtattyggttaattttttgtattttttatagagayggggtttttatygtgttagttaggatggttttgattttttgatttygtgattygtttgtttgggttttttaaagtgttgggattataggygtgagttatygygtttagtttg

SEQ ID NO: 14703 - DNA, 201 bp, Artificial Sequence
  Description of Artificial Sequence: Synthetic polynucleotide
gatygttttttygttattgtatttatataatttgttttaaatgggtaatttattaagtatattttgtttttgttttygtygtaggtttttgtyggatygtygtttataagtttttatagttygtgagtttttttagtttggttyggtttattttgtggygtttaygtttatttygggtttttttygatttttttttaattt

SEQ ID NO: 14704 - DNA, 201 bp, Artificial Sequence
  Description of Artificial Sequence: Synthetic polynucleotide
gtagtgtagtggygtaatttyggtttattgtaagtttygtttttygggtttaygttatttttttgttttagttttygggttagttgggattataggygttygttattgtgttaggttaattttttgtatttttagtagagatggggttttattatattagttaggatggtttygattttttgatttygtgatttattygtt

SEQ ID NO: 14705 - DNA, 201 bp, Artificial Sequence
  Description of Artificial Sequence: Synthetic polynucleotide
ttygtgtttttttttttygagtyggygggttatagaygtyggaagaaattttygtatttgtagttggaattgtagtttayggygtttyggttttttttttygttttgtttttttttggttaaataatatattaaagaggygaggtaatgattgttggttagtttttatyggggaaaaatttattgttaggatggtatgaat

SEQ ID NO: 14706 - DNA, 201 bp, Artificial Sequence
  Description of Artificial Sequence: Synthetic polynucleotide
ggaataaatatttttgttttataaagatttagaatttattggatattgataaaatgtttattagaggtyggygtagtggtttatgtttataatttyggygyggtggtttatatttgtaatttygaygtggtggtttatatatgtaattttagtatttygtaaggttaggtggggggattatttgagtttaggagtttatga

SEQ ID NO: 14707 - DNA, 201 bp, Artificial Sequence
  Description of Artificial Sequence: Synthetic polynucleotide
gtggtgtaattttggtttattgtaagttttgtttttygggtttatgttatttttttgttttaggttttygagtagttgggattataggtgtatattattaygttyggttaatttttttgtatttttagtaaagayggggttttattatgttagttaggatggtttygattttttgattttgtgatttattagttttagttt

SEQ ID NO: 14708 - DNA, 201 bp, Artificial Sequence
  Description of Artificial Sequence: Synthetic polynucleotide
gtaaattttttgtaaaattttggttttttagattttagttgggtttttttttttaggtttttagtggtagttgtgttttttgtgtgtttaygtyggttagygtaagttatatatggatttagtgtttattgtatttttgttagttttagggttttagttygttgtttygggagattttagttttggtttaggtattttttt

SEQ ID NO: 14709 - DNA, 201 bp, Artificial Sequence
  Description of Artificial Sequence: Synthetic polynucleotide
ttttaatttttttattaagatggagttttgttttatygtttaggttggagtgtagtggygygattayggtttattataattttygtttttygggtttaagygatttttttgttttagtttttygagtagttgggattataggtatgtgttattatgtttaggtaattttagtatttttagttgagayggggttttattatg

SEQ ID NO: 14710 - DNA, 201 bp, Artificial Sequence
  Description of Artificial Sequence: Synthetic polynucleotide
ttttgttaggygyggtggtttatgtttgtaattttagtattttggaaygtygaggtaggygaattaygaggttaagagatygagattatttttgttaatayggtgaaatttygtttttattaaaaatataaaaaattagtygggygtgggggygggygtttgtagttttagttgttygggaggttgaggtaggagaatygt

SEQ ID NO: 14711 - DNA, 201 bp, Artificial Sequence
  Description of Artificial Sequence: Synthetic polynucleotide
attattttttttttttttgagayggagttttgttttgtygtttaygttggggtgtagtggtaygatttyggtttattgtaagtttygtttttygggtttaygttatttttttgttttaatttttygagtagttgggattataggtatatgttattatattyggttaatttttttgaatttttagtagagaggggttttatt

SEQ ID NO: 14712 - DNA, 201 bp, Artificial Sequence
  Description of Artificial Sequence: Synthetic polynucleotide
ttygygaattygggtggtgttttttttttgtattatttagaygtgtttttaggaaggaygtgttgttatgattygttatggtggtttyggggatggttagyggygggatgatgggtgtgatgtggtttyggggatggttagyggtaggatgatgggtgtgaygtatttgtgttatttgggatttaaatttatttatgattt

SEQ ID NO: 14713 - DNA, 201 bp, Artificial Sequence
  Description of Artificial Sequence: Synthetic polynucleotide
attgggttttatygtgttagttaggatggtttygattttttgattttgtgattagttygtttyggttttttaaagtgttggtattataggygtgagttatygttttyggtaaagttttttttygatggttttagtttgttggataagttaggaataaggttattggttgtaagggaggaggagtttttgtaggtggtagyg

SEQ ID NO: 14714 - DNA, 201 bp, Artificial Sequence
  Description of Artificial Sequence: Synthetic polynucleotide
ggtgatttaaatygtttatgtggaatatatatatatatatatatatatatatatatgtgttttagggayggatatatataaataygtgttttaggggtttygtgtgaggagaggagatttatattattgatttagtaattagggtygattttagagggttggagtatatatttygggttgaygataggygtttggttttgg

SEQ ID NO: 14715 - DNA, 201 bp, Artificial Sequence
  Description of Artificial Sequence: Synthetic polynucleotide
tttyggttygtttttttttattttaggttgttttaatttttttttgaaagtttggygtttattttttattttttgggaaatattttgtygttttggggtgygtttygtgaaggagataygttgggtgaaagttagggattttataattatttttygtttttatttygggtttagtgtaggggttgtygtgaaggtattggt

SEQ ID NO: 14716 - DNA, 201 bp, Artificial Sequence
  Description of Artificial Sequence: Synthetic polynucleotide
aggttgttgggaaggaattggtttttatggaagtgttttagtttttttgttttttyggtttttttttttyggttgttttagtgttttattgaaagtttggygttatatttttatttttygggaaattttatgtttttttggggtgtttttygtggggaagataygtattttgggtgaaagttagggattttatgaatattt

SEQ ID NO: 14717 - DNA, 201 bp, Artificial Sequence
  Description of Artificial Sequence: Synthetic polynucleotide
attaatttaaatatttattaatgatagattggataaagaaaatgtggtggggtggagttaagatggtygaataggaatagtttyggtttatagtttttagygtgagygaygtagaagatgggtgatttttgtatttttaattgaggtaaygggtttattttattggggagtgttggatagttggtgtaggatagtgggtgt

SEQ ID NO: 14718 - DNA, 201 bp, Artificial Sequence
  Description of Artificial Sequence: Synthetic polynucleotide
gttygttattatattyggttaattttttgtatttttaatagagayggggttttatygtgttagtaaggatggtttygattttttggtttygtgattygttygygtyggtttttygaagtgttgggattataggtatgagttatygygttyggttagaagtgtttttatttgtttgggaagttgtttttttttggtatttgt

SEQ ID NO: 14719 - DNA, 201 bp, Artificial Sequence
  Description of Artificial Sequence: Synthetic polynucleotide
ttttttattttaaggaataagtttttaattagattagatatagttataagtaaatataaattatgtttttatgtaattttaagagttattttaggtygggygyggtggtttatgtttgtaattatagtattttyggaggtygtggygggyggattaygaggttaggagattgagattattttggttaatatggtgaaatta

SEQ ID NO: 14720 - DNA, 201 bp, Artificial Sequence
  Description of Artificial Sequence: Synthetic polynucleotide
ggttaattaggggtaygtttttttatgtatatggygggtatttttattttagttggtyggtagtggtatygtatatggtattttatatttgtatttttttygttttggtttagtgtggttagggatgggttttgttagtttgtagygttattygttttgtgtaaggtttagaattgtttatttaygtaagtygggagttyg

SEQ ID NO: 14721 - DNA, 366 bp, Artificial Sequence
  Description of Artificial Sequence: Synthetic polynucleotide
tgagygaygtagaagaygggtgatttttgtatttttatttgaggtatygggtttattttattagggagtgttaggtagtgggygtaggttagtgggtgygygtatygtgggygagtygaagtagggygaggtattgttttatttgggaagygttaggggttagggagtttttttttygagttaaggaaaggggtgatygaygtatttagaaaatygggttatttttattygaatattgygttttttagatyggtttaaaaaatggygtattaygagattatattttatatttggtttggagggttttaygtttayggaattttattgattgttagtatagtagtttgagattaaattgtaaggygg

SEQ ID NO: 14722 - DNA, 201 bp, Artificial Sequence
  Description of Artificial Sequence: Synthetic polynucleotide
ataaaggttttttaagtttatattagatttaygagtttagttggttttatttagtggatttygtatygggggtygtaggtggagttgtttgttagtttygygtagtgtttttatagtttttagtttttgggyggtygatgggatygggygtygtggagtagggggtagygtttattggggaggttyggttttgtaggagtt

SEQ ID NO: 14723 - DNA, 201 bp, Artificial Sequence
  Description of Artificial Sequence: Synthetic polynucleotide
ggtgtygtttgttatttttttttttgattaggaaagggaattttttgattttttgtgttttyggagtgaggtaatgtttygttttgtttyggttygygtgyggtgygttgtatttattgttttgygtttattgtttggtattttttagtgagatgaattyggtattttatatggaaatgtagaaattatttattttttgyg

SEQ ID NO: 14724 - DNA, 201 bp, Artificial Sequence
  Description of Artificial Sequence: Synthetic polynucleotide
gtygttttgtagtttgattttagattgttgtgttagtaattagygagatttygtgggtataggatttttygagttaggtgygggatataatttttaggtgygtygttttttaagtttgttggaaaagtgtagtatttyggttggagtgattygattttttaggtgttgtttgttatttttttttttgattgggaaagggaa

SEQ ID NO: 14725 - DNA, 384 bp, Artificial Sequence
  Description of Artificial Sequence: Synthetic polynucleotide
ttgaattgttttaattttaagyggtttagttttaagttttgygagagtattatyggttagggtttgtagatygtggtygttaattgttttgatttttagaygttgaatgtttaggattgygaggttttygtggaggttttgygttttgttaaaygttattgtaagygttgygttatygagtatattaattyggtttttttttgaagggatagagtttattyggygttgtatttatataaatttgaataaagtaaatttttttaaaagtagygtatgtaagtatygatatttatttaaaatagttttttttttygggaaggttattaggaatttggtttttatttttttttattttttatgggtaatagaggttaaagaaaygaa

SEQ ID NO: 14726 - DNA, 216 bp, Artificial Sequence
  Description of Artificial Sequence: Synthetic polynucleotide
gaagaygggtgatttttgtatttttatttgaggtatygggttaattttattagggagtgttagatagtgggygtaggttagtgggtgygygtatygtgygygagtygaagtagggygaggtattgttttatttgggaagygtaaggggttagggagtttttttttygagttaaagaaaggggtgatggaygtagttggaaaatygggttattttta

SEQ ID NO: 14727 - DNA, 334 bp, Artificial Sequence
  Description of Artificial Sequence: Synthetic polynucleotide
tgatatagaagayggtgatttttgtatttttatttgaggtatygggtttattttattagggagtgttagatagtgggtataggttagtgggtgygygtatygtgygygagtygaagtagggtaaggtaatgttttattygggaagygttaggggttagggagtttttttttttagttaaagaaaggggtgayggaygtatttggaaaatygggttatttttattygaatattgygtttttyggatyggtttaaaaaayggygtattaygagattatatttygtatttggttyggagggttttattygayggagtttygttgattgttagtatag

SEQ ID NO: 14728 - DNA, 201 bp, Artificial Sequence
  Description of Artificial Sequence: Synthetic polynucleotide
gggattttaaggttttgttggtgyggtttaaaggtatyggaygttggggttaagatgattttygygttgttatgaattaggttattggaygygggtttygygtygagtttgtagttttygaggagtttttygggttttttygttttgattatattttttyggatggttgtygggtttttgtttgtttygttttgtatygag

SEQ ID NO: 14729 - DNA, 270 bp, Artificial Sequence
  Description of Artificial Sequence: Synthetic polynucleotide
gttattgtattttagtatgggtgatagagttagtttgaaattttgttttgygtttttttgagaagtgatagtgtatyggtatggtagtttttatagttttygttygtttttggygttttttyggttttggtatttattttggtygygtttgaggagttttttagttygtygttgtattgtggaagtttatttttgggttggttaaggtyggagtyggtttttttagtttgyggggaggtgtggagggagaggtaygggygggaatygggg

SEQ ID NO: 14730 - DNA, 253 bp, Artificial Sequence
  Description of Artificial Sequence: Synthetic polynucleotide
ygtgagygaygtggaagataggtgatttttgtatttttatttgaggtatygggtttattttattagggagtgttagatagtgggygtaggttagtgggtgygygtatygtgygygagtygaagtagggygaggtattgttttatttgggaagygtaaggggttagggagtttygttttygagttaaagaaaggggtgayggaygtatttggaaaatygggttatttttatyggaatattgygttttttygatc

SEQ ID NO: 14731 - DNA, 204 bp, Artificial Sequence
  Description of Artificial Sequence: Synthetic polynucleotide
ttttagtaggggyggtygggtagaggygttttttatttttyggayggggyggttggtygggtaggggggttgattttttttatttttttttyggayggggyggyggtaaagattgagatagtttygttgttygttgaattttattttttyggttaaaattaagttttttaataaagattttgaagtgttgagtttattaattta

SEQ ID NO: 14732 - DNA, 228 bp, Artificial Sequence
  Description of Artificial Sequence: Synthetic polynucleotide
gttattttgtagtttgattttagattgttgtgttagtaatyggygagatttygtgggygtaggatttttygagttaggtgygggatatagttttttgatgygtyggtttttaagttygtaggaaaagygtagtattygggtgggagaggtttgattttttaygtgttgtttgttatttttttttttgattaggaaagggaattttttgattttttgtgtttttygagt

SEQ ID NO: 14733 - DNA, 217 bp, Artificial Sequence
  Description of Artificial Sequence: Synthetic polynucleotide
ygtaggatgtagattgtagaygtttatygtttygtaggtagttttagttygagtggtggtygtgttgggtttgtgttyggggttttttttygtatgttttygttttttagtgtttgygatgaygtgygatttattaattattyggatttagygtatttttatgttaaatagygygtgtttatttgtaaagtataygatagtttttgyggttattggg

SEQ ID NO: 14734 - DNA, 201 bp, Artificial Sequence
  Description of Artificial Sequence: Synthetic polynucleotide
ttatttttgaagttattgagattataagtttattggaaggaattaatttyggatatattttgggtgttygtttgggatattgttatayggtgagtattatyggattygtttgggatattgttatayggtgagtattttyggatttgttttattttttattttgttttatttttttttagaatttaggggttaaatatygga

SEQ ID NO: 14735 - DNA, 204 bp, Artificial Sequence
  Description of Artificial Sequence: Synthetic polynucleotide
aagataataaattggttttaaataaaaagtaagaaaaatgttggggaggagttaagatggttaaataggaatagtttyggtttatagtttttagygtgagygaygyggaaaatgggtgatttttgtatttttatyggaggtatygggtttattttattagggagtgttagatagtgggtataggttagtgggtgtgygtatygt

SEQ ID NO: 14736 - DNA, 223 bp, Artificial Sequence
  Description of Artificial Sequence: Synthetic polynucleotide
tagtgggtatatagaggtagtygggattygtttggaagagttttygttyggggtaaggagtygggattgtgtttaggaggtagtggggagtttyggagagygaagygttttttgygtagattygygtgtttggagtatyggagtttgtagggtaagagagggtttttagaagatttaygaygttttattgggatgtagagggaaayggttatttgtattttta

SEQ ID NO: 14737 - DNA, 201 bp, Artificial Sequence
  Description of Artificial Sequence: Synthetic polynucleotide
tttaaagtattaggattataagtagaattatygygttttttgtttttttttttgtttttgtttttgttttgttgttgttgttgatgttgttatagagtttygtttttgtygtttaggttgggatgtaatggtgtgatttyggtttattgtagttttygtttttyggttttaagtaatttttttgttttagttttgtgagta

SEQ ID NO: 14738 - DNA, 203 bp, Artificial Sequence
  Description of Artificial Sequence: Synthetic polynucleotide
agtataaataaattggtygggyggtagttttagttattygggaggttgaggtagtagaatagygtgaattygggaggyggagtttgtagtgagtygagatygygttattgtattttagtttgggtgatagagtgagattaygttttaaataaaaaaaaaaaaaaaaaaaaaaagtatttttttagatttagtttgatattagg

SEQ ID NO: 14739 - DNA, 201 bp, Artificial Sequence
  Description of Artificial Sequence: Synthetic polynucleotide
ttaygttyggttaatttttttgtattattagtagagaygaggttttatygaggttttatygtgttagtygggatggtttgggttttttgatttygtgattygtttaattyggttttttaaattgttgggattataggtatgagatatygygttyggttgttgtttgattttttttagtagtgttttgtagttttttttgta

SEQ ID NO: 14740 - DNA, 201 bp, Artificial Sequence
  Description of Artificial Sequence: Synthetic polynucleotide
ttttygagtagttgggattataggtgtttgttatttygttyggttaattttttgtatttttagtagagatggggttttatygtgttagttaggatggtttygattttttgatttygtgattygttagtttyggttttttaaagtgttgggattataggygtgagttatygygttyggtttaatttaatttttaataatggt

SEQ ID NO: 14741 - DNA, 201 bp, Artificial Sequence
  Description of Artificial Sequence: Synthetic polynucleotide
aaaagttatagggggygtgaggatagayggygtgtttttttttatatatatggagaygtaggtyggagtaayggtatayggattaygtataygyggyggaygtattaaygtttaygtagaagagaataaaagtygtttttaattgggtataaattttttgtatttaaatatttygatatttataaataaaattagaataga

SEQ ID NO: 14742 - DNA, 201 bp, Artificial Sequence
  Description of Artificial Sequence: Synthetic polynucleotide
tgatttgtttttttyggttttttaaagtgttgggattataggygtgagttatygygttyggtttaggttattttttttttttttttttttttttttgaggyggagtttygttttgtygtttaggttggagtgtagtggygygatttyggtttattgtaagtttygtttttygggtttatatgatttttttgttttagtttt

SEQ ID NO: 14743 - DNA, 201 bp, Artificial Sequence
  Description of Artificial Sequence: Synthetic polynucleotide
ggattataggygtgagttatygygttyggtttaaattatggattttttttttttagtggagtttygtttttgtttaggttggaataggatggtaygaattyggtttattgtaatttttatttttygggtttaagygatttttttgttttagtttttygagtagttgggattataggtatgtgttattatgtttggttagta

SEQ ID NO: 14744 - DNA, 201 bp, Artificial Sequence
  Description of Artificial Sequence: Synthetic polynucleotide
aattttttttttatttttttygtttttttattttataaaatygttattgttattatggtttatttttaatgagttgttgggtatattttttagayggggtygtggtygggtagaggggttttttattttttagtaggggyggtygggtagaagygttttttatttttyggatggggyggttggtygggyggggggttgatt

SEQ ID NO: 14745 - DNA, 201 bp, Artificial Sequence
  Description of Artificial Sequence: Synthetic polynucleotide
gggggttttttaagtttagttttgggttygggtyggggtatagggtagagygggtttttttagtttttgttatgaggttaaggtagtgtatygttygtagygtatatttagaaattaaagtttaggagttggttattatttyggtttatagttgatggaagagtaggtgttttygagaatttatagtgttttttggttagt

SEQ ID NO: 14746 - DNA, 201 bp, Artificial Sequence
  Description of Artificial Sequence: Synthetic polynucleotide
tgggtagtagagtgagattttgttttaaaaaaaaaaaaaaaaagggggggtygggtgyggtggtttaygtttgtaattttagtattttgggagatygaggygggtagattaygaggttaggagatygggattattttagttaaaayggtgaaatttygtttttattaaaaatataaaaaattagtygggygtagtggyggg

SEQ ID NO: 14747 - DNA, 201 bp, Artificial Sequence
  Description of Artificial Sequence: Synthetic polynucleotide
gtgggagttatagggttttaggggaggagygttttaggtygyggtaatagtaggtgtaaaggttttgaggtaggayggggtagggaggtttagagtttatygygtagagattygggaggtyggtaggtayggtgaggattttgatttaaatttaggaaaggggaattatattggggtatgattttttgtatttttygagat

SEQ ID NO: 14748 - DNA, 201 bp, Artificial Sequence
  Description of Artificial Sequence: Synthetic polynucleotide
gggatttttttatgttggttaggttggtttygaatttttgattttaagtgatttatttgtttyggttttttaaagtgatgggattataggtatgagttatygygttyggttaagggtttttttagatgtaattaagttaagatgaggttatattgagttaggtgggttttaaatttaatggttagtgtttttataagtata

SEQ ID NO: 14749 - DNA, 211 bp, Artificial Sequence
  Description of Artificial Sequence: Synthetic polynucleotide
gttttagggtyggaggagtaggagatttgggtagyggggtgggygagtgtygggaggaggtaagaggtygygggggaggaagaygtttttttyggttttgyggggtaggtygygtagggtaggtygtgyggggtaggtggggggtgttaaggaagttygggygtggttatatygtagagaaagttatgggaggtaygttttgagagttggg

SEQ ID NO: 14750 - DNA, 201 bp, Artificial Sequence
  Description of Artificial Sequence: Synthetic polynucleotide
gtagttaaagttatttttttggttgaaagatatttttttyggggggaggagttaagatggtygagtaggaatagtttyggtttatagtttttagygtgagygataaagaagaygggtgatttttgtatttgtatttgaggtattyggtttattttattagggagtgttagatagtgggygtaggttagtgggtgygygtat

SEQ ID NO: 14751 - DNA, 201 bp, Artificial Sequence
  Description of Artificial Sequence: Synthetic polynucleotide
gtttaggatttgtagtttattatgtttgagttttttatttattttatgggtttttgtgtygtttaagtttttyggaygagtgttattttttgttttayggygtttagttttatygattatttaagggttgaggaatgtgagtatayggygtaggattggtaggtagttttatttgtagtttyggtgtgggatttattaggt

SEQ ID NO: 14752 - DNA, 201 bp, Artificial Sequence
  Description of Artificial Sequence: Synthetic polynucleotide
tggtaatattgtgaagaygtaggttttttatgggaaagattgttgttyggaagtttttatataataggtttttattgagattttaaggttgatagtayggygggagtttttgggatttttgggttyggtatagygttatygtagtaggtaggtatygggtggttagaagtygattatttttttaaatggtttgtatatatt

SEQ ID NO: 14753 - DNA, 201 bp, Artificial Sequence
  Description of Artificial Sequence: Synthetic polynucleotide
tttttatgggttgatttggtgattttttatggagaatgygtaggagtyggatattggtattgttaggtggaaaagttttttgttagggtgaaaagttagayggygtttgtttttygtttttggagtgtttttggtttaaygtagtagtttygtagataaaygttatagaaggtagagygttttatagatatgaaggagtgg

SEQ ID NO: 14754 - DNA, 201 bp, Artificial Sequence
  Description of Artificial Sequence: Synthetic polynucleotide
gatttttggattygttgggttgttttygtattyggttttttttttttaagtttgyggtygggtgtggtttttttaattttagygtygattttygtgtttgygygttttttttttattttttttattygyggggttaggggttatayggtatygtygtttgggttttygagtagggagagtygagtgttgattttgttagaa

SEQ ID NO: 14755 - DNA, 201 bp, Artificial Sequence
  Description of Artificial Sequence: Synthetic polynucleotide
ggatattttataaaatttttgaygagttttttttaaaattattaggttggtygggtgyggtggtttatgtttgtaattttagtattttgggaggtygaggygggtagattataaggttaggagatygagattattttggttaatayggtgaaatttygtttttattaaataatataaaaaattagttgggygtggtagygg

SEQ ID NO: 14756 - DNA, 201 bp, Artificial Sequence
  Description of Artificial Sequence: Synthetic polynucleotide
tttttttttatttttttaggggtttgattttttttttaatygtatttttatagaatggtyggttagataggaagtttyggttggygaagtttagttttygygggtataggttggygaattttagagattygggattygggtaggtttygtattygattttttatayggtttygatggagtagtagtagaygtttattyggt

SEQ ID NO: 14757 - DNA, 201 bp, Artificial Sequence
  Description of Artificial Sequence: Synthetic polynucleotide
aaattagttaggtttggtggtaggtatttgtaattttagttattttaggggttgaggtaggagaattgtttgaattygggaggtggaggttgtagtgagtygagattgygtttttgtattttagtttgggggataagagtgagatttygttttaaaaaaaaaaaaaaaaaaaaaaaaaggtygggtggtttatatttgtaa

SEQ ID NO: 14758 - DNA, 201 bp, Artificial Sequence
  Description of Artificial Sequence: Synthetic polynucleotide
tatygttatgatttgygagygygtgttttttatttygttagagttggtagtgtgygttatttattyggtgttyggttattatygttttaygtggayggygyggttggtttttaygtaygygttttyggtggtygaggtygaygtggaygtgttgttgtttatttttatgtttttgygtttttatttgttgggtygggtgat

SEQ ID NO: 14759 - DNA, 201 bp, Artificial Sequence
  Description of Artificial Sequence: Synthetic polynucleotide
ttygyggggttygttygtttttttagtygttgtttttygggyggygttygtyggygtygatttttataatttattttttttagatagagtttttttttgtygtttaggttggagggaagtggtatgattttagtttattgaaatttatttttttygggtttaagygatttttatttttgtttttggagtagttgggattat

SEQ ID NO: 14760 - DNA, 201 bp, Artificial Sequence
  Description of Artificial Sequence: Synthetic polynucleotide
ttattttagttttttgagtagttgggattataggtttgtgttattatgtttagtttattttttattttattttatttttatttttattttttttttgagayggagtttygttttgtygtttaggttggagtgtagtggygggatttyggtttattgtaagtttygtttttygggtttaygttatttttttgttttagtttt

SEQ ID NO: 14761 - DNA, 201 bp, Artificial Sequence
  Description of Artificial Sequence: Synthetic polynucleotide
aaatggtgatttagaggtygtttttattygaygggtttttttagtygaagaygtttagttaatgaattttaagtagatttatggtygggtgtgaagttaayggagtttttatttygtggagaygagtagtataaatttttgtttttaatgtttaatgatatgtaaaatatttaaatttgtaaygtagaattattaagttgt

SEQ ID NO: 14762 - DNA, 201 bp, Artificial Sequence
  Description of Artificial Sequence: Synthetic polynucleotide
ggtaggyggattattttagtttaggagttygagattagtttgggtaatatggtaaaattttatttttataaaaaatataaaaattagtyggttatggtgtygtgtatttgtagttttagttattagggagattgaggtgggagggttatttaagtttgggagaggygggtgtggtggaggttgtagtgagttaagatgtat

SEQ ID NO: 14763 - DNA, 201 bp, Artificial Sequence
  Description of Artificial Sequence: Synthetic polynucleotide
tagattgatagattttttttttttttgagatggagttttgtattgttattygggttggagtgtagtggtgtaatttyggtttatygtaatttttttaattygygtttaagtaatttttttgttttagtttttygagtagttgggattatagggygtgttattaygtttggttaattttttgtatttttagtagagatgggg

SEQ ID NO: 14764 - DNA, 201 bp, Artificial Sequence
  Description of Artificial Sequence: Synthetic polynucleotide
tttygggyggtaaggattttayggtgttggtataygtgttgygtaygttggtatygggtttgggtattttattgtagtttatggttgtagataagggtatygggygtggtttagygggaggattttagtaaggagttggggaaataygtatgtgtttatttagggtyggagtttattgaaggtttatgtgggtagtaygtg

SEQ ID NO: 14765 - DNA, 201 bp, Artificial Sequence
  Description of Artificial Sequence: Synthetic polynucleotide
yggtttattgtaatttttatttttygggtttaagygatttttttgttttagttttttgagtagttaggattataggtatgtattattattttyggttaatygttgaatttttagtagagayggggttttattaygttygtaaggttggtttygaatttttgattttaggtgatgtttttaygtyggttttttaaagtgtta

SEQ ID NO: 14766 - DNA, 201 bp, Artificial Sequence
  Description of Artificial Sequence: Synthetic polynucleotide
yggttttttaaagtgttgagattataggygtgagttatygygttyggtttattttaggtgatttattttttttagttttttaaagtgttgagattataggygtgagttattaygtygggtttattttaggtgatttatttttttyggttttttaaagtgttgagattataggygtgagttatygygttyggtttattttag

SEQ ID NO: 14767 - DNA, 201 bp, Artificial Sequence
  Description of Artificial Sequence: Synthetic polynucleotide
gatttgagaatygtttgtattagtttggttttttgtatagtgtttgygtyggtgtatattttagaggggagttgygttattagatgaattaggattttggyggaggaagggggtgtyggtagggtttttatggtatttgttgtttgtggttgaggggagtttggaagggtattagttttatttatttttggtygagatttt

SEQ ID NO: 14768 - DNA, 201 bp, Artificial Sequence
  Description of Artificial Sequence: Synthetic polynucleotide
ttyggtatatttagagtatattggggttggggtagatggtggtatttgttttggttggaggagttgggagggttggggaagggaygtgtgatttttttttygataaatttggaygagatgttaagtataatatagaggttggyggyggggtttttttttgttttyggtggattaatttattgtgggattttgggtaatttt

SEQ ID NO: 14769 - DNA, 201 bp, Artificial Sequence
  Description of Artificial Sequence: Synthetic polynucleotide
ttaaaaaatatatayggtygggygyggtggtttaygtttgtaattttagtattttgggaggtygaggtgggyggattaygaggttaggagatygagattayggtgaaatttygtttttattaaaaaaatataaaaaattagtygggygtagtggygggygtttgtagttttagttgttygggaggttgaggtaggagaatg

SEQ ID NO: 14770 - DNA, 201 bp, Artificial Sequence
  Description of Artificial Sequence: Synthetic polynucleotide
ayggttatatggtagggtttttgttgtttttatygtygttagtttagtygttygttattttttttagtggtgtttttgttattaatgggttttttataatygattyggtttaygggttgtagatgttgyggattattggygtggggaagtatgagtttatygattyggggtattttagaggtaagttttgttgttaygtgt

SEQ ID NO: 14771 - DNA, 279 bp, Artificial Sequence
  Description of Artificial Sequence: Synthetic polynucleotide
gggtttgggttygttaggtgtagaataaggagaaaggggtagaggggaagagtygggtygaattttagygagggattyggttttttttggaggagaggatygtattygygttaggagtatggatttatttagggagtgtttgggyggagaagtagtttttgttttaggtttttygttgyggtatttaaagaggtygggyggtttagaggttygtaagttaygtttttttttaggtttygttttygtttggttattttttttgttgttagtttttttatt

SEQ ID NO: 14772 - DNA, 201 bp, Artificial Sequence
  Description of Artificial Sequence: Synthetic polynucleotide
ttggttgttatgaaattataaattatgtttatagaaattttagtttgagaaagaatttagatttttttttttttttttttttttttttgagattgagtttygttttgtygtttaggttggagtgtagtgatgttatttyggtttattgygagttttgtttttygggtttaygttattttttggttttagtttttygtgtag

SEQ ID NO: 14773 - DNA, 201 bp, Artificial Sequence
  Description of Artificial Sequence: Synthetic polynucleotide
tygggggyggggyggggyggggyggggyggggygggggggtggggttgaggtaggagaatggygtgaattygggaggyggagtttgtagttagtygagatygtgttattgtattttaattygggygatagygattttattttaaaaaataataataataaaaaagaataaagattttataggtattttttttatagtagag

SEQ ID NO: 14774 - DNA, 201 bp, Artificial Sequence
  Description of Artificial Sequence: Synthetic polynucleotide
ggggttttatygtgttagttaggatggtttyggttttttgatgtygtgatttttttatttaggttttttaaagtgttgggattataggygtgagttatygygttyggtttagttttttatttttaataagtttttaggtgatgtttatgttggtagttttttgagattattatattttaagttttagggtgttagaaaaac

SEQ ID NO: 14775 - DNA, 201 bp, Artificial Sequence
  Description of Artificial Sequence: Synthetic polynucleotide
tgttgttgttgtttttaagttggagttttgttttgttatttaggttgtagtgtagtggtaygatttyggtttattataatttyggtttttygggttttagygatttttttgttttagttatttaagtagttgggtttataggygtatgttattaygtttggttaatttttgtatttttaggagagataggtttttattatg

SEQ ID NO: 14776 - DNA, 201 bp, Artificial Sequence
  Description of Artificial Sequence: Synthetic polynucleotide
aatygagttgtggaatggggtttygtggagtaggttgagtgtgtyggtygtggaygggtygtgggygggattttttagtgtgttattattgaggtattttygtttttttaygtgtttttgtttttttttttagaagtttaatattttygagaggatttaaaatatagagtgattagtttttatgtgtattttttggataaa

SEQ ID NO: 14777 - DNA, 201 bp, Artificial Sequence
  Description of Artificial Sequence: Synthetic polynucleotide
aggggagaygaagaaggagggggtagttygtttaggaggttaggggggtattygtgttyggtttaggtttatygaygtagatattattgatatttaygttygygttgtgttttttgyggygtttgyggtygttaatgttatttattgggyggtataygttatgtgagtataggatttaggttattttygtttgttttggyg

SEQ ID NO: 14778 - DNA, 201 bp, Artificial Sequence
  Description of Artificial Sequence: Synthetic polynucleotide
ttatatattttaygygttttgtttattaygaggtttgtattttttgggtagtaggtgtygygygttttygggtattttgtaggtggagtygtyggygtagygtagtatttygtgtttttgaygtyggtttyggatttagtygtygtygtatttgttatygtttttgggggatataygtayggagtttatttttaatagggg

SEQ ID NO: 14779 - DNA, 201 bp, Artificial Sequence
  Description of Artificial Sequence: Synthetic polynucleotide
tttattataaatataaaaaattagtygggygtggtggygggtatttgtagttttagttattyggaaggttgaggtaggaaaatgatgtgaattygggaggyggagtttgtagtgagtygagatygygttgttgtatttaagtttgggygatagagygagatttygggttaaaaaaaataaaagaatatagggtatggtatt

SEQ ID NO: 14780 - DNA, 201 bp, Artificial Sequence
  Description of Artificial Sequence: Synthetic polynucleotide
tagagtagttgggattataggygtttattgttaygttyggtttatttttttttgtatttttagtagagayggggttttatygtgttagttaggatggtttygattttttgaygtgatttattygtttyggttttttaaagtgttgggattataggygtgagttatygtgttyggtttatttatgtgttttttgggaagggg

SEQ ID NO: 14781 - DNA, 201 bp, Artificial Sequence
  Description of Artificial Sequence: Synthetic polynucleotide
aggygttygttattaygttyggttaattttttgtatttttagtagagayggggttttattatgttagttaggatggtttygattttttgattttgtgattygtttatttygtttttttaaagtgttgggattataggygtgagttatygtgttyggttgtttttyggtatattttttatttttagtatgtggtttttatat

SEQ ID NO: 14782 - DNA, 203 bp, Artificial Sequence
  Description of Artificial Sequence: Synthetic polynucleotide
gttggttatggaaggttatagtttygtagatggtgtyggtggagtttggggtagggtattttgagtttgggaaggtttggggtgaaggttyggaggttggygygtaggaggttaaagtagtagggaggtttggggagagttaggtggggttgtgttttttaygttgtaggtygtgtttatagatggtgaaagaygttgtggaa

SEQ ID NO: 14783 - DNA, 201 bp, Artificial Sequence
  Description of Artificial Sequence: Synthetic polynucleotide
ttttaagtagttgggattataggygtttattattaygttyggttaatgtttttgtttttttagtagagayggggttttatygtgttagttaggatggtttygattttttgatttygtgattttttygtttyggttttttaaagtgttgggattatagtaattattygatggygtgagttatygygttyggttatgtatgat

SEQ ID NO: 14784 - DNA, 201 bp, Artificial Sequence
  Description of Artificial Sequence: Synthetic polynucleotide
tttatttttgtgaaaatttttgtgtttgaaaattattgtaaaatatttggaattattattattatttatttttattttttgagayggagtttygttttgtygtttaggttggagtgtagtggygygatttyggtttattgtaagtttygtttttygggtttaygttatttttttgttttagtttttygagtagttgggatt

SEQ ID NO: 14785 - DNA, 201 bp, Artificial Sequence
  Description of Artificial Sequence: Synthetic polynucleotide
ttggygagagataaggtatttagggaaagaagaaaaaagtttaggaagggattttagtttgttagattyggggtagaagtttttttyggaygagtttttayggagaaatttaaatattaggggtttyggaaggtyggaagtttttaagttgtttaggaaaagattaaagagatataaattataaaagttttgggattttta

SEQ ID NO: 14786 - DNA, 201 bp, Artificial Sequence
  Description of Artificial Sequence: Synthetic polynucleotide
gttattgattttgagttttygtttttttatttataaaattgagattagggtygggtatggtggtttatttttgtaattttaatattttgggaggtygaggygggyggattaygaggtgaggagtttgagattagtttgattaatatggtgaaatttygtttttattaaaaatataaaaattagtygggygtggtggygygt

SEQ ID NO: 14787 - DNA, 201 bp, Artificial Sequence
  Description of Artificial Sequence: Synthetic polynucleotide
gtatgtttattgtagaattatttataatagtaaagatatggatagatyggattaagaaaatgtggtgtatatatatatatgttatggaatattatgtagtygtaaaaagaataaaattyggttttttgtagtaatatggatgtagttggaggttattattyggagtgaattaatataggaatagaaaattaaatattgttt

SEQ ID NO: 14788 - DNA, 201 bp, Artificial Sequence
  Description of Artificial Sequence: Synthetic polynucleotide
ttttagtttygtgatyggttttttgttttgtgttgatatttagtatttttttyggtttttgtttygaggggaaaataaaataggggtttttaggttttatygttggtttattttatygtagtaaatygatygagggttttttgttgygtttttgyggtttgttgttttatttagyggttttgatattyggtatttatttaa

SEQ ID NO: 14789 - DNA, 201 bp, Artificial Sequence
  Description of Artificial Sequence: Synthetic polynucleotide
gygggyggattaygaggttagtagattgagattattttggttaatatggtgaaatttagtttttattaaaaatataaaaaattagtygggtgtggtggtaygygattgtagttttatttattggggaggttgaggtaggagaatygtttgaattygggaggyggaagttgtagtgagtygagatygygttattgtattttc

SEQ ID NO: 14790 - DNA, 201 bp, Artificial Sequence
  Description of Artificial Sequence: Synthetic polynucleotide
ttttattttttagttagttttttgtgtagtgtttagggtttyggtagttaggatagagygagtaaaagaagatggatagtggatagggygtagtggtttaygtttgtaattttagygttttgggagagygaggygggtagattataaggttaagagattaagattattttggttaatatggtgaaattttgtttttattaa

SEQ ID NO: 14791 - DNA, 201 bp, Artificial Sequence
  Description of Artificial Sequence: Synthetic polynucleotide
aaggtaggyggattayggggttaggagttygagattagtttggttaatttggtgaaaattygtttttattaaagatataaaaattagttgagtgttgtggygtaygtttgtaattttagttattggggaggttgaggtaagagaattatttgtaatygggaggyggaggatgtagttagygagatggygttattgtatttt

SEQ ID NO: 14792 - DNA, 201 bp, Artificial Sequence
  Description of Artificial Sequence: Synthetic polynucleotide
atttagggggttgaggtaggagaatygtttgaattygggaggyggagtttgtagtgagtygagattgagttattgtatattttagtttgggtaataagagygagatttagttttagaaaaaataaataaataataaaataaaaagtaggtygggtgygatggtttatatttataatattagtattttgggaggtygaggtg

SEQ ID NO: 14793 - DNA, 3238 bp, Artificial Sequence
  Description of Artificial Sequence: Synthetic polynucleotide
tagaaygttaggygtgaaaggtgaygttgaggtagtaygagggaaaaagtagtaggtagygatygttatayggaygatagtgttttttyggtagtttttgygttagattyggggttgtygtggagtttttgatttgaatttagggtgygtgtygygtttayggggggatattttaaagyggtaagaatgttttttgggaagggaataggaygttaggtttgaaaggggattttgaagtagtttaggaaaaaattttttayggattayggtgttttttyggtagtttttttgttaggttygagggggttgttgtgttttaggtttgtatttagggttttayggggggtattttaaagyggtaagtaggtttttaggggaaggggatagtaygttaggtttggagggggaygttgaggtagtttygggaataaagaggggatgttggggttttgttayggataatattgttttttygatagtatttgtggtgggtttgggagygttatggagtttttggtttgtatttaaggtgygtgtttygttttyggggggtattataaagyggtaagaaggttatygggggaagggtatgggaygttagggttgaaagggatagttgaggtagttyggggaaaaaygtggtaggttggggtygttttatggaygatagtgtttttttagtagtttttgygttaggttyggggtggtygtggagtttttggtttgtatygagggtgygggtygtatttatgggggtattttaaagtggtaagaaggtygtygggygaaygttatagaaggttaggttttaatggggatgttgaggtagtatagagagaaaagyggttagtygggttttttttayggatgatagtgtttttttggtagtttttgygttgggttyggggggatygtggagtttttattttgtatttagggtgygtgtttygtttatgggaggtattttaaagyggtaagtaggtttttgggggaaggggatagtattttagatttgaagggggattttgaggtagttygtggaaaaaaayggygaygttgagttttttttataaaygatagtgtttttttggtagttttttygttgggttagggtggttttggagttygtggtttgtatttagggtgygtgtttygtttaagggggtattttaaagyggtaagtagattttygggggaagggagagtaygttaggtttgaaggggaggttgaggyggtttyggggtaaaagtggtgaagttggggtttttttayggatgatatygtttttttggtagtttttgtagtgggtttagaggtgtygtggagtttttggtttgtttttaggttgtgtgtttygtttaygagtggtattataaagtagtaagaaggtttttaggggaagggtataggattttagggttgaaaggtagagttgaggtagatyggtgttattttaaggataatagtgttttgttyggtagtttttgtatygggtttggggtggttgtggagtttttggtttgtattyggggtgygtgtygtgtttaygatgggtatygtaatgyggtaagaagttttygagtggaagggaataggaygtygagtttgaaaggggaygttgaggtagttyggggaaaaaatttttattgagaatagtgttttttyggtagtttttgagtgggatttaggtggayggtggagtttttggtttggatttagggtgtttgttttgtttayggggtgtaygtgaaagtggtaatagggttttygggggaaggggataatatgttaggtttgaagagggaygttgggttagttagaggaaaatagyggttaggttgtggtygttttatagattatagtgttttttyggtagtttttgagtttggtttaggygggggggtttggagtttttgttttgtaatagagtgygtgtttygtttaagtgtgtaygygaaagttgtaagaagggtttygggggaagggaataggatgttaggtttgaaaggggattttgaggtagtttagggaaaaattttttayggaggatagtgatttttygatattttttgygtttggttttgggggttttggagtttttggtttatatttagggtgygtgtttygtttaygggtggtattttaaagtagtaagaaagtttyggggggggaagaataggatgttagatttgaaaggggaygttgaggtagtttaggaaaaaaaggggygaggttggggtttttttayggatgatagtgttttttttatagtttttatgttagtttygggagggtygyggagtttttgttttgtatataatgtgygtgtttygtttayggggggtattttaaagtggtaagaagtttttygygggaaggtaataggaygttaggtttgaatggggaygtttaggtagtttggagaaaaaagtagygaggttggggtgattttaygaatgatagtgttttatyggtagtttttttgtygggtatgygggggttgttgattttttggtttgtatttagggtgagtgttttgtttayggygggtattataaagtagtaagaaggttttygggggaaagggatagtaygttagttttgaagggggaagttgaggtagtttyggggaaaaaaagyggggatgttggggtttttttayggaygatattgtttttttagtagtttttgtagtgggttygggagygttttggagtttttgttttgtatttygggtgygtgttttatttayggggagtattataaagyggtaagaaggttattgggggaagggtataggaygttagggttgaaggggatagtggagatagtttaaggaaaaaagtggygggatggtgtygttttaaggatggttatttttgygtygggttagggatggtygyggagtttttggtttgtatttaggttgtgtgtttygtttatagggggtattttaaagtagtaygaaggtttttaggggaagggaagaggaygttaggtttggaaggtgaygttgaggtagtagggggtaaaaagtggygggtygggtttttttayggatgatagtgttttttyggaagtygttgygtagggttyggygtgtttgtggagtttttggtttgtatttagaatygtgyggygtttaygaygggtattttaaagyggtaagatatttttygttggaagggaataggatgttaggtttgaaaggagaagttgagttagttyggggaaaaa

SEQ ID NO: 14794 - DNA, 201 bp, Artificial Sequence
  Description of Artificial Sequence: Synthetic polynucleotide
ttaaggttattattttaaagtgttttagaaaataatatatagaaggtygggygyggtggtttaygtttgtaattttagtattttgggaggtygaggggggyggattaygaggttaggagatygagattattttggttaatayggtgaaatttygtttttattaaaaatatatatatataaaattagtygggygaggtggta

SEQ ID NO: 14795 - DNA, 201 bp, Artificial Sequence
  Description of Artificial Sequence: Synthetic polynucleotide
ttattatttatttattattttgtttgtaatttgggttattatttattagtaatttgatgattaataygttttattttagtaggtgtgtaaggtgygggggyggatataaagattgyggttttyggagaggayggttagggggtygtttttgtaagtgttttttaaaataattggttatygttttygagtgtttgggygtyg

SEQ ID NO: 14796 - DNA, 201 bp, Artificial Sequence
  Description of Artificial Sequence: Synthetic polynucleotide
ayggtgattagaaatgtattaaattttgaatgtataaaagagagagttttaatatgaaatagtaattttttgagaaygaagatttygtagtgtyggtgttygttgggtygtgtaggtttyggtygttttaygttygtgttygtttttatygtgattttttygttttyggtaygtttagggttaattttygggtttattgta

SEQ ID NO: 14797 - DNA, 201 bp, Artificial Sequence
  Description of Artificial Sequence: Synthetic polynucleotide
tttggggattattttgtttttttgttttgattttttttttttttttttttttttttttgagayggagtttygttttgtygtttaggttggagtgtagtggygygatttyggtttattgtaagttttatttttygggtttatattatttttttgttttagtttttygagtagttgggattataagtattygttattaygttc

SEQ ID NO: 14798 - DNA, 201 bp, Artificial Sequence
  Description of Artificial Sequence: Synthetic polynucleotide
ttttygggayggggggatttttaggtattttygggttttgagttgggtygttagggtygttygttttttgtygttttttttgggtygagtttygttttygygttttgtagtggagtagtygtttttaaaggtgtaygtgattagggtgyggtygggatagygggtattttttygggttttagygtygygtgygttttggtc

SEQ ID NO: 14799 - DNA, 201 bp, Artificial Sequence
  Description of Artificial Sequence: Synthetic polynucleotide
yggygttyggtatgaaattttttttttttttttgagatagagtttygtttttgygtttaatttggagtgaagtggtaygattttggtttatggtaattttygtttygtaggattaagttattattttgatttagtttttygagtagttgggattataggtatttattattatggtyggttaatttttgttttttgtttttt

SEQ ID NO: 14800 - DNA, 201 bp, Artificial Sequence
  Description of Artificial Sequence: Synthetic polynucleotide
aagtagttttttaaaattttaaaaagtaagtatagttttaggaaggagggaggttagtgaaattaaatttttgtygataagtttaaagtaattggtaagaygttgggaaattagatattgaaatattygtttttaatttttaatttgttattatttgaaataaagttattagggatagtygggygyggtggtttaygtttg

SEQ ID NO: 14801 - DNA, 201 bp, Artificial Sequence
  Description of Artificial Sequence: Synthetic polynucleotide
atttattgaagaagttgaagtgtgaagtgtgaaattgaagaattttgaaatgtattgagtagtgaaaagattatgtatataaaaataggttggtygggtgyggaggtaggtagattatttgaggttaggaggygygatttyggtttattgtaagttttatttttygygtttaygttatttttttgttttagttttyggagt

SEQ ID NO: 14802 - DNA, 201 bp, Artificial Sequence
  Description of Artificial Sequence: Synthetic polynucleotide
attttgggaggttaaggtaggyggttgggaggtgtaggttgtagtgagtygagattaygttattgtattttagtttgggtattattgagtattgagtgaaygagatttygtttgtaatttyggtatttygggaggtygaggttggyggattattygyggttaggggttggagatyggttyggttaatatagygaaattttg

SEQ ID NO: 14803 - DNA, 201 bp, Artificial Sequence
  Description of Artificial Sequence: Synthetic polynucleotide
gtggygtaatttyggtttattgtaagtttygttttttaggtttatgttatttttttgttttagttttttgagtagttggtattataggygtygattattaygttyggttaattttttgtattttttgatagagayggggttttatygtgttatttaggatggtttygatattttgattttgtgattygtttgtttyggttt

SEQ ID NO: 14804 - DNA, 201 bp, Artificial Sequence
  Description of Artificial Sequence: Synthetic polynucleotide
gagtgtagtggtgtgattttggtttattgtaagttttgttttttgggattatgttatttttttgttttagttttttgagtggttgggatttataggtgtttgttaatatgtttggttaattttttgtatttttagtagagatggggttttattgtgttagttaggatggttttgatattttgattttgtgatttgtttatt

SEQ ID NO: 14805 - DNA, 208 bp, Artificial Sequence
  Description of Artificial Sequence: Synthetic polynucleotide
ttggttaatatgatgaaattttgtttttattaaaaatataaaaaattagttgggtgtggtggtgggtgtttgtagttttagttatttgggagattgaggttgaatggtgtgaatttgggaggtggagtttgtagtgagttgagattatattattgtattttagtttgggtgatagagtgagattttgttttaaaaataaataaataaa

SEQ ID NO: 14806 - DNA, 201 bp, Artificial Sequence
  Description of Artificial Sequence: Synthetic polynucleotide
atatggtgaaattttgtttttattaaagtataaaaaattagttgggtatagtggtataggtttttagttttagttatttgggaggttgaggtaggagaattgtttgaatttgggaggtggagggtgtagtgagttattgtatgttagtttgggtaatagagttagattttgttttaaaaaaaaaaaaaaaaaagaaagaaa

SEQ ID NO: 14807 - DNA, 201 bp, Artificial Sequence
  Description of Artificial Sequence: Synthetic polynucleotide
gttgaggtgggtgaattatttgaggttaggagtttaagattagtttggttaatatggtgaaattttatttttattaaaaatataaaaattaattgggtattgtggtgtgtgtttgtaattttagttatttgggagattgaggtaggagaattgtttgaattttgttggtagaggttgtaatgagttgagattgtattatgg

SEQ ID NO: 14808 - DNA, 201 bp, Artificial Sequence
  Description of Artificial Sequence: Synthetic polynucleotide
ttttggaggttatatttggataggagttggtttttaattttagttaagagtttatagaggggtttttgtttaattgtatggagtttatggttgataggtgtggtggtaggatgggatgggattggatgggttgtgtatttgtttttatattagtattatattgttttgattattttagtttgtaagatgtttgaaatttat

SEQ ID NO: 14809 - DNA, 201 bp, Artificial Sequence
  Description of Artificial Sequence: Synthetic polynucleotide
aaaattataataaagtttttgtttaattatagattttgatttattggttaggtaggttgtttggtttttgatttgtatttagagggtttttggattttggtgttgtgtgggttagtgttttgggagttggggattggtattggttgtgtttggttgttgagtgtgttttattaattattattttgtttttttaggttaatg

SEQ ID NO: 14810 - DNA, 201 bp, Artificial Sequence
  Description of Artificial Sequence: Synthetic polynucleotide
gaggttttttttatttaggtaaagaagaaagaaggatggttttaggagtttatataatatggttaaaggttgggtagtgtgtagtagaatgtaagatgagtggttaggttatagggtgagattatgaaggatttttttttggttttaaatgttttttaagagtgtttttttattatttttttttttattttttaagaatag

SEQ ID NO: 14811 - DNA, 201 bp, Artificial Sequence
  Description of Artificial Sequence: Synthetic polynucleotide
tttttaagtagttgggattataggtgtttgttattatgtttggttaatttttaatatttttagtagagatggggttttattgtgttagttaggatggttttgattttttgattttgtgatttgtttgttttggttttttaaagtgttgggattataggtttgagttattgtgtttggtttttagtttttatatttgttaaa

SEQ ID NO: 14812 - DNA, 201 bp, Artificial Sequence
  Description of Artificial Sequence: Synthetic polynucleotide
ttaatataaaaattagttgttttagttgggtgtggtggtttaagtttgtaattttagtattttgggaggttgaggtgggtggattatgaggttaggagattgagattattttggttaatatggtgaaattttgtttttattaaaaatatataaaaaatgagttgggtgtggtggtaggtgtttgtagttttagttatttag

SEQ ID NO: 14813 - DNA, 201 bp, Artificial Sequence
  Description of Artificial Sequence: Synthetic polynucleotide
taaattttgttgttgtttattttatgggtttatattgtttttatgagttgtaatatttattgtaaaggtttgtaggtttatttttgagttggtaagattatgaatttattagaagaaattttgaatatatttgaatattagaaggaataaattttggatatgttatttttaagaattgtaatatttattgtaagggtttgt

SEQ ID NO: 14814 - DNA, 201 bp, Artificial Sequence
  Description of Artificial Sequence: Synthetic polynucleotide
ttttgttttagtttttttagtagttgggattataggtgtttgttattgtgtttggttaattttttgtatttttaatagaaatggggttttattgtggttttgattttttgattttgtgatttgttgtttattttggttttttaaagtgttgggattataggtgtgagttattgtgtttggtttttttttttatttttaata

SEQ ID NO: 14815 - DNA, 201 bp, Artificial Sequence
  Description of Artificial Sequence: Synthetic polynucleotide
ggggttttattgtgttagttaggatggttttgattttttgattttgtaatatgtttgttttggttttttaaaatgttgggattataggtgtgagttattgtgtttagttggttttataggtatttatgtatattaatagtttttttttgagatggagttttgttttatttttaggttggagtgtaatggtgttgttttgat

SEQ ID NO: 14816 - DNA, 235 bp, Artificial Sequence
  Description of Artificial Sequence: Synthetic polynucleotide
ttaattttttaggtgttgtttgttatttttttttttgattaggaaagggaattttttgattttttgtgtttttggagtgaggtaatgttttgttttgttttggtttatgtagggtgtgtgtatttattgatttgtgtttattgtttggtattttttagtgagatgaatttggtattttagatggaaatgtagaaattatttattttttgtgttgttttttttgggagttgtagat

SEQ ID NO: 14817 - DNA, 201 bp, Artificial Sequence
  Description of Artificial Sequence: Synthetic polynucleotide
ggtagataaagatatatgattagggttggttgtggtgatttatgtttgtaattttagtattttgggaggttaaggtgaatggattatgaagttaggagattgagattattttggttaatatggtgaaattttgtttttattaaaaatataaaaaattagttgagtgtggtggtgggtgtttgtagtgttagttatttgggg

SEQ ID NO: 14818 - DNA, 201 bp, Artificial Sequence
  Description of Artificial Sequence: Synthetic polynucleotide
taggtgatttttgtatttttatttgaggtattgggtttattttattagggagtgttagatagtgggtgtgggttagtgggtgtgtgtattatgtgtaagttgaagtagggtgaggtattgttttatttgggaagtgtaaggggatagggagttttttttttgagttaaaaaaaggggtgatagatgtatttggataattag

SEQ ID NO: 14819 - DNA, 201 bp, Artificial Sequence
  Description of Artificial Sequence: Synthetic polynucleotide
agagatagaagttgttggagggtgagaggaatgtattagtggaagaagatagaagtggttggttatggagagtatgttagtagaagaatatatttatagatgttggtttgtttgtgggttttttggtaggttattgattggtgggatgaggtggagtttgttttgggtagtaggaggatagtttgggtatttagtggttta

SEQ ID NO: 14820 - DNA, 201 bp, Artificial Sequence
  Description of Artificial Sequence: Synthetic polynucleotide
tttatagaggtaggtaggtttttttgagttgtggtgggttttatttagtttgagttttttggttgttttgtttatttaagtgagtttgggtaatggtgggtgttttttttttagttttgttgttgttttgtagtttgattttagattgttgtgttagtaattagtaagatttggtgggtataggattttttgagttaggtg

SEQ ID NO: 14821 - DNA, 201 bp, Artificial Sequence
  Description of Artificial Sequence: Synthetic polynucleotide
gtttttttttttagttaaagaaaggggtgatagaaggtatttggaaaattgggttatttttattagaatattgtgtttttttgatgggtttaaaaaatggtgtatttggagattatatttggtatttggtttagagggttttatgtttatagagttttgttgattgttagtatagtagtttaagattaaattgtaaggtgg

SEQ ID NO: 14822 - DNA, 201 bp, Artificial Sequence
  Description of Artificial Sequence: Synthetic polynucleotide
tgtttgttatttttttttttgatttggaaagggaattttttgattttttgtgttttttaggtgaggtaatgttttgttttgttttggtttgtgtatggtgtgtgtatttattggtttgtgtttattgtttggtatttttttagtgagatgaatttggtattttagatggaaatgtagaaattatttgttttttgtgttgtt

SEQ ID NO: 14823 - DNA, 201 bp, Artificial Sequence
  Description of Artificial Sequence: Synthetic polynucleotide
gtaagtaaggggtgtgttttagttttgtttgtgttagagtttttttatttttattatttggtaggtttagtgtttgggaataatgatgtatgtggataagtggagggtgagtaaggtgaagaggagttttattgagtaatagaatagtttagaggagatttgtggtgggtagtttttttttgtagttagggtgttttgatg

SEQ ID NO: 14824 - DNA, 201 bp, Artificial Sequence
  Description of Artificial Sequence: Synthetic polynucleotide
ggtagattatttgaggttaggagtttgagattagtttggttaatatggtgaaattttgtttttattaaaaatataaatattagttgggtgtggtggtggttgtttgtaattttagttatttgggaggttgaggtaggagaattgttggattttgggaggtagatgttgtagtgagttaagattatgttattgtattttagt

SEQ ID NO: 14825 - DNA, 201 bp, Artificial Sequence
  Description of Artificial Sequence: Synthetic polynucleotide
ttgtagtatatattattatttttttagtatattattattttttaatttggtttttattgttaataaagttgttggttgtaggaatgagagagtggtagaatgatatttttgttttattttttgggattttttagttgttggtggttttaagtttttaggagttatggtgttttttttttttagatgttagtgttaatagtg

SEQ ID NO: 14826 - DNA, 201 bp, Artificial Sequence
  Description of Artificial Sequence: Synthetic polynucleotide
ggttagaagatggtgagtggaaagtttgggtgtgtggagagattttaagaaggggttgtttagttgtgaattttgtatttgttgtttgtgttttatttggtggttttgaaattaggtttttatttggatttttgtgagttgtatatttttggttagttatttttgttttagagggtttagatattggtagtgttggaagac

SEQ ID NO: 14827 - DNA, 207 bp, Artificial Sequence
  Description of Artificial Sequence: Synthetic polynucleotide
gtttttgtgatttttgtagttagtgaattagtatatttttggggttgaagttatgtgttaggtatgttagtgttattagtttgtttagggttagtttttttgatggtggtggtagtaggtggattttgggttggaatgtgttttttggagggtagagagttaggttagggggttgggtaggggatgagagagtttttttgttttggt

SEQ ID NO: 14828 - DNA, 201 bp, Artificial Sequence
  Description of Artificial Sequence: Synthetic polynucleotide
tttatggggtagttagaagggagatggtttttttttggagttggggtgtttggtagttttggtttttttttgattgtttaggttaatttttgtttttttttgttggtttatggtttattggtttttgggtgtttgttagtgtgtttttttgttggggtgtttttatggatgattagtgtttgtgttttttttttttgatgt

SEQ ID NO: 14829 - DNA, 201 bp, Artificial Sequence
  Description of Artificial Sequence: Synthetic polynucleotide
gaagatgggtgatttttgtatttttatttgaggtattggttttattttattagggagtgttagatagtgggtgtaggttagtgggtgtgtgtattgtgtgtgaagtagggtgaggtattgttttatttgggaagtgtaaggggttagggagttttttttttgagttaaagaaaggggtgatggatgtatttggaaaattgg

SEQ ID NO: 14830 - DNA, 201 bp, Artificial Sequence
  Description of Artificial Sequence: Synthetic polynucleotide
ggggtgtggttttttggagggaattagtgtggagatgtttgtgtgtttggggtgtggttttttggagggagttagtgtggagatgtttgtgtgtttggggtgtggtttattagagggagttagtgtggagatgtttgtgtgtttggggtgtggttttttggagggaattagtgtggagatgttggtgtgtttggggtgtgg

SEQ ID NO: 14831 - DNA, 201 bp, Artificial Sequence
  Description of Artificial Sequence: Synthetic polynucleotide
gatgttttttattttttagatggggtggtggtggggtagagatattttttagtttttagatggggttgtggtttggtagaggtgttttttatattttagatgatgggtggttgggtagagatgttttttattttttagatgggatgatggttaggaagaggtgttttttattttttagattgggtggttgggtagaggggt

SEQ ID NO: 14832 - DNA, 201 bp, Artificial Sequence
  Description of Artificial Sequence: Synthetic polynucleotide
gagtatagtgttggtgggttggtattgttgggggatttggtgtattttttatagttgttgttttgggtggtaagttttttattgtttggggttggtggggtggttagttgtttggagtgtggggtttgttaaggttatgtttatttagaatttgttttggtttattgtgagtagttttagtttttgttttgtgtttttttt

SEQ ID NO: 14833 - DNA, 201 bp, Artificial Sequence
  Description of Artificial Sequence: Synthetic polynucleotide
tttttgagtagttggggttataggtgtttattattatgtttggttaattttttgtatttttagtagagatggggttttattgtgttagttaggatggttttgattttttgatgttgtgatttattgttttggttttttgaaatgttgggattataggtttgagttattgtatttggttatatttatttatttttaattaga

SEQ ID NO: 14834 - DNA, 201 bp, Artificial Sequence
  Description of Artificial Sequence: Synthetic polynucleotide
ttttttttttttttgattggttttgtttttattgttggttttgtttttattgttggtttgggttttatttatgttggagttgttttatttaaggagattgtgtagttggaaagttatatgtgtgagtttagaggtgggttttggttgtagatttgttatggtttttgaagtttttgtgtgtttaggggtgttttttggttg

SEQ ID NO: 14835 - DNA, 201 bp, Artificial Sequence
  Description of Artificial Sequence: Synthetic polynucleotide
gttagttagttattttgagatggagttttgttttgttgtttaggttgtagtgtagaattgtttttttggtttattgtaatttttattttttgggtttaagtgataattttgttttagttttttaagtagttggaattatagatgtgtattattatgtttaattaatttttgtatttttagtagagatggggttttgttata

SEQ ID NO: 14836 - DNA, 201 bp, Artificial Sequence
  Description of Artificial Sequence: Synthetic polynucleotide
gtggttttttttgatttagattgtttttaaatattgaatgttgaattgggttgggtgtggtggtttttatttgttattttagtattttgggaggttgaggtgggtggattatgaggttaggagattgagattattttggttaatatggtgaaattttgtttttattaaaaatataaaaaaaaaaaattagttgggtgtgat

SEQ ID NO: 14837 - DNA, 201 bp, Artificial Sequence
  Description of Artificial Sequence: Synthetic polynucleotide
ttatttttgttttttattttgggggttttatgattttggagtttttatgttttggtatagagtttgtttttttgggattgggttttggttgagtagatattgtttagttgttttttgattagtgttttttgttttgtgtttggttggtattggtggtttgttgagtttagtttggtattttgttggtattggtggtttgtt

SEQ ID NO: 14838 - DNA, 380 bp, Artificial Sequence
  Description of Artificial Sequence: Synthetic polynucleotide
ttttattaaaatataaaaaattggttgggggtggtggtatgtgtttgtagttttagttatatgggaggttgaagtaggggaattgtttgaatttgggaggtggagattgtagtgagttgagattgtgttattgtattttaatggtattttagtttgatgatagagtgagattttgttttaaaaataataataaataaataaataaataaataaaaattagttgggtgtggtggtgtgtgtttgtagttttagttatttgggagattgaggtaggagaattgtgggaatttgggaggtggaggttgtagtgagttgagattgtgttattgttttgtagtatggagatagagttagattttgtttaaaaaaaaaaaaaaaaa

SEQ ID NO: 14839 - DNA, 201 bp, Artificial Sequence
  Description of Artificial Sequence: Synthetic polynucleotide
aggtgggtggattatgaggttaggagattgagattattttggttaatatggtgaaattttgtttttattaaaaatataaaaaattagttgggtgtggtggtgggtatttttagttttagttatttgggaggttgaggtaggagaatggtgtgaatttgggaggtggagtttgtagtgagttgagattgtgttattgtattt

SEQ ID NO: 14840 - DNA, 201 bp, Artificial Sequence
  Description of Artificial Sequence: Synthetic polynucleotide
aaaaattagtttggtgtggtggtatgtgtttgtaattttaattatttgggaggttgtggtaggtgaattatttgaagttgggaggtgaaggttgtagtaatgttgttttttgtattggatgaagtgttttttattaaatttttttattggagagggtgggatttgtgggttttttgggtggtttgattttgatattttgtg

SEQ ID NO: 14841 - DNA, 201 bp, Artificial Sequence
  Description of Artificial Sequence: Synthetic polynucleotide
atggtgaattgtggtgattgtgatgtgtttttttattttttttttggtggattttttttatttgttttttttttaatttttaataagtttttattattgatgatgtgagatgatgatggtatgggattttttattttgttagggttaatgaattttatattatgagttgtatgaggtatgagggagtttttaagggaggaa

SEQ ID NO: 14842 - DNA, 201 bp, Artificial Sequence
  Description of Artificial Sequence: Synthetic polynucleotide
gatgtagaagatgggtgatttttgtatttttatttgaggtattgggtttattttattagggagtgttagatagtgggtataggttagtgggtgtgtatattgtgtgtgagttgaagtagggtgaggtattgttttatttgggaagtgtaaggggttagggagttttttttttgagttaaaggggtgatggatgtatttgga

SEQ ID NO: 14843 - DNA, 201 bp, Artificial Sequence
  Description of Artificial Sequence: Synthetic polynucleotide
taaataattagggataaagagtattatattgttgaatttattttatttttaattttttttttaaattttttataaaaaattagttgggtgtggtggtgggtgtttgtagttttagttatttagagattgaggtaggagaatggtgtgaatttgggaggaggagtttgtagtaagtggagattgtgttattgtattatagtt

SEQ ID NO: 14844 - DNA, 201 bp, Artificial Sequence
  Description of Artificial Sequence: Synthetic polynucleotide
atttttgtgatttatattttatttgtatattttttttttttttgaaaatttttaataaaaatttgttggttttatggtttaggggtattatagaatttattgatatgtgatgttttttttggatgtttggttttaaaattttttttttttgtattttgtttttttattttttaatttggttgatgtttagggaaaatagaa

SEQ ID NO: 14845 - DNA, 201 bp, Artificial Sequence
  Description of Artificial Sequence: Synthetic polynucleotide
ttttggtgaatttttattgttataattttaaaaatttggtttagggaggagtttattttttattttttatataggtgatatatgtagaaatataatttgttgttgtgtttgtgtggttaggattttttttttatatgtaatgatttagttgattagtttaagatatgtttggtttttatgtttgtttgtaggggtattgtt

SEQ ID NO: 14846 - DNA, 201 bp, Artificial Sequence
  Description of Artificial Sequence: Synthetic polynucleotide
ttgggagtagaggttttttggaaggtattatttttagagtgtgtttttgagtaattttgaggatgggttttgggttattattgtgtgttggaaatagtagtgtttaggttgttggaggaggttggtttttttggtaggttttggttgtgtttagagttttgtgggttttggagataaggttttggtttgaggtttttgggg

SEQ ID NO: 14847 - DNA, 201 bp, Artificial Sequence
  Description of Artificial Sequence: Synthetic polynucleotide
gtttgagtaggataaggattttagagtttaagagaattttgatgattagagaagggtttttgaggttattggggatgtatggtttgtattttggtttttgtgggataatggaggtttttttttttttttgtgtttgggtttgggtttttgtagatagatttttatatttagaggtgagaaattagatataattagatattt

SEQ ID NO: 14848 - DNA, 201 bp, Artificial Sequence
  Description of Artificial Sequence: Synthetic polynucleotide
ttatatgttaggttataaaataagtttttagaaatttaagaagattgaaattatattaattattttttaaaaaaaataggtggttgggtgtggtggtttatgtttgtaattttagtattttgggaggttgagatgggtggattatgaggttaggagattgagattattttggttaatatggtgaaattttgtttttattaa

SEQ ID NO: 14849 - DNA, 568 bp, Artificial Sequence
  Description of Artificial Sequence: Synthetic polynucleotide
ttagtatatagatataaaaatgagaggtgatagtgtgttggtagtttttatagtttttgtttttttttggtatttttttggttttggtgtttattttggttgtgtttgaggagttttttagtttgttgttgtattgtgggagtttttttttgggttggataaggttggagttggtttttttagtttgtgggtaggtgtggagagagaggtgtgggtgggaattgtggttgtaggttgtgtttgtgggttagtttgagttttgggtgggtgtgggtttggtaagttttgtatttggagtggttagttggtttgggtagtgaggagtttagtatttgggttagtagttgttgtgtttgattttttgttgggttttagttgtttttttgttgggtagggtttgggatttgtagttttttatgtttgagtttttatttttgttgtgtgtttttgtgtagtttaagtttttttgatgagtgttaatttttgttttatggtgtttagttttattgattgtttaagggttgaggagtgtgggtatatggtgttggattggtaggtagttttattt

SEQ ID NO: 14850 - DNA, 201 bp, Artificial Sequence
  Description of Artificial Sequence: Synthetic polynucleotide
tttattaaaaatataaaaaattagttgggtattatggtgggtgtttgtagttttagttatttgggaggttgaggtaggagaatggtgtgaatttgggaggtggagtttgtagtgagtggagattgtgttgttgtattttagtttgggtgatagagtatgagtttgttttaaaaaaagaaaaaaaagaaagaaaagaaaaga

SEQ ID NO: 14851 - DNA, 201 bp, Artificial Sequence
  Description of Artificial Sequence: Synthetic polynucleotide
gggttggttaaggttggagttggttttttttgtttgtggggaggtgtggagggagaggtgtaggtgggaattagggttgtgtggggtgtttgtgggtaagtgtgagttttgggtgggagtgggtttggtaaatttattttagggtgttttgttttttataaagaaaattttttttggggtttttatgggtttttttgggat

SEQ ID NO: 14852 - DNA, 201 bp, Artificial Sequence
  Description of Artificial Sequence: Synthetic polynucleotide
ttttaagtagttgggattataggtatttgttattatgtttggttaattttttgtattttttagtatagatggggttttattgtgttaattaggatggttttgattttttgattttgtgatttgtttgttttggttttttaaagtgttgggattataggtgtgagttattgtgtttagttatatattatattttttttattt

SEQ ID NO: 14853 - DNA, 201 bp, Artificial Sequence
  Description of Artificial Sequence: Synthetic polynucleotide
aattatggggtgaattttgttatggggatatgtatttggggggaaggttgtgatgggaggggtatttgggttaaatatgggtggttgttagtgaagagtttgtaagatagagtaggagttagggggaatagggagggaggggtattttttttttttttttttgagatggagttttattttgttttttaggttggagtgtag

SEQ ID NO: 14854 - DNA, 201 bp, Artificial Sequence
  Description of Artificial Sequence: Synthetic polynucleotide
tataggagtataaaagggttggtggttttgtttgggtatattgtttgtttttttatttatttgtgtattttagtttattatttttgagttgggtgtagtatgtggtttagagaatgggaagggatttatgagtgtttgatatatataattattgttgttggtgattatttttatttatgagtggtgtatggatggggttag

SEQ ID NO: 14855 - DNA, 201 bp, Artificial Sequence
  Description of Artificial Sequence: Synthetic polynucleotide
taaaggtttgtttttgtatttaagtatttgagtttttaagagttagtttttgggtttttttggagtaaggttttgtttggttttatgtatttgttttgtttgttgtgatggtgagtttgttgttgggtttgtttttgttaatttggtttttggtgtatatgtggatgttgtaggtggaggaagggtggatattaatgatgg

SEQ ID NO: 14856 - DNA, 201 bp, Artificial Sequence
  Description of Artificial Sequence: Synthetic polynucleotide
tttggttggttttgggatttgttttttggtggttaagtagtggttatgaaagtttagttgttgttatatttttgaggaattggtgtatttttgtttatagtggtagttgggggtatttatgtggtttggggttgttttgatttggtagtgtatgggggttgttgtttgggttttttagtgtgttatttgtgtgttttttgt

SEQ ID NO: 14857 - DNA, 201 bp, Artificial Sequence
  Description of Artificial Sequence: Synthetic polynucleotide
tttggtgttggtatttattagtgtggttagtttggttgaagttttgtggaagggtgggattaggtgttgtattgttgtgtttagggattggaattggtgttgtttgtaggttatgaggtttattatggagtttagtgttgtattttgtgagaggggtggatgtgggggttgtagggattttagatggtttgggattgattt

SEQ ID NO: 14858 - DNA, 201 bp, Artificial Sequence
  Description of Artificial Sequence: Synthetic polynucleotide
tggttattttgggagtttgttgttgatgaattgtagtatggttatttgggttgtttattttgtatggttatgttgtttggttattgttgtaggtatgttttgttttgtttaattttttggttggtggggttatttgggtgtttgtatatgattttttttgagagggttagaggttggtttaattatttgtaaataatgtta

SEQ ID NO: 14859 - DNA, 201 bp, Artificial Sequence
  Description of Artificial Sequence: Synthetic polynucleotide
ttagtatataggatatttatgtgtgtttattatttggtatatgggagatttatgtgtgtttattgttgggtataggggagatttatgtgtgtttattgtttggtatatgagagatttatgtgtgtttattgtttggtatagggagatttatgtgtgtttattgtttggtataggggagatttatgtgtgtttattgtttgg

SEQ ID NO: 14860 - DNA, 201 bp, Artificial Sequence
  Description of Artificial Sequence: Synthetic polynucleotide
aggggaatagtaatagaagttttatttattaggtatttattgtgtgttaagtattgtgttaagggttttatagaataatagtataagaattttggttgggtgtagtggtttatttttgtaattttagtattttgggaggttgaggtgggtggattatgaggttaggagttagagagattagtttagttaatatggtgaaat

SEQ ID NO: 14861 - DNA, 201 bp, Artificial Sequence
  Description of Artificial Sequence: Synthetic polynucleotide
tgtatgtattgtgtgtgagttgaagtagggtgaggtattgttttatttgggaagtatgaggggttagggagtttttatttttagttaaagaaaggggtgatggatgtatttggaaaattgggttatttttatttgaatattgtgtttttttggtgggtttaaaaaatggtgtattatgagattatattttatatttggttc

SEQ ID NO: 14862 - DNA, 201 bp, Artificial Sequence
  Description of Artificial Sequence: Synthetic polynucleotide
gtttgttattatgtttggagaattttttgtatttttagtggagataggtttttattatgttagttaggatggttttgattttttgattttgtgatttgtttgttttggttttgtaaagtgttgggattataggtgtgaggtatagtgtttggttttgattgttttatttaaagtaatgaaagtatagttggttttaaagga

SEQ ID NO: 14863 - DNA, 201 bp, Artificial Sequence
  Description of Artificial Sequence: Synthetic polynucleotide
tttgtggttagttggattaggtggttggtagtgagatggaataagtagattaggttgagggtgaaggtgtaggtgattagtagtatggataagaggttgttgtttgttattttttttattgtttggtttagtatttatttatttgtttgtagtaagtttagtagtattattttggttgttgttgttattttattttgttgg

SEQ ID NO: 14864 - DNA, 201 bp, Artificial Sequence
  Description of Artificial Sequence: Synthetic polynucleotide
ttagattgttttttttttgagatagagttttgttttgttatttaggttagagtgtggaggtgtgattttagtttattgtaagttttgttttttgggtttatgttatttttttgttttagttttgtgagtagttgggattataggtgtttgttattgtgttggttaatttttttggtatttttagtagagatagggttttat

SEQ ID NO: 14865 - DNA, 201 bp, Artificial Sequence
  Description of Artificial Sequence: Synthetic polynucleotide
atagtttattaaaaatataaaaaaaaaaaaaaaaaaatttgttgggtgtggtggtgtgtgtttgtaattttagttatttgggaggttgaggtaagagaattgattgaatttgggaggtagagattgtagtgagtttagattatgttattgtattttagtttggataagagtgagattttattttaaaaataaaaataaaaa

SEQ ID NO: 14866 - DNA, 201 bp, Artificial Sequence
  Description of Artificial Sequence: Synthetic polynucleotide
tgtttttttttgttttgagatggagttttattttattgtttaggttggagtgtagtggtgttattttggtttattgtaatttttattttttgggttttagtgatttttttgttttagttttttaagtagttgggattgtaggtgtttataattatgtttggttaatttttgtgtttttagtagagttggagttttattatg

SEQ ID NO: 14867 - DNA, 201 bp, Artificial Sequence
  Description of Artificial Sequence: Synthetic polynucleotide
tgtttgttattaagtttagttaatttttgtatttttagtagagatggggttttattgtgttggttaggttggttttgaatttttgattttgtgatttgtttgttttggttttttaaagtgttaggattataagtgtgagttattgtgtttggttttttaaatggtatttttgattttttttttttagtttttaaagtaggt

SEQ ID NO: 14868 - DNA, 201 bp, Artificial Sequence
  Description of Artificial Sequence: Synthetic polynucleotide
gttaaggtgggtggattatttgaggttaggagtttgagattagtttggttaatatggtgaaattttatttttattaaaaatatggaaaaaattagttgggtggggtttgagtttgtaattttagttatttgggagttgaggtgtgagaattgtttgaagttgggagggggaggttgtaggagtagaggttgtgttattgta

SEQ ID NO: 14869 - DNA, 201 bp, Artificial Sequence
  Description of Artificial Sequence: Synthetic polynucleotide
ggtttgtatggtgtgtgattatttttagtggaagttttaatatgggtgtggtttagttttttagggttttttaaggtagaggtggtttgggtttttgtagtgattttataatatattttaattgtagatggtggagattgtgggttgttttttggtttaagtggttttggggtttttgttttgtgtggagttatttgtgtt

SEQ ID NO: 14870 - DNA, 201 bp, Artificial Sequence
  Description of Artificial Sequence: Synthetic polynucleotide
gtgttttgggttattgagagaagtgaaatattgtagatatggtagaggtgttttttttttttttttgtttttagatgtggtttttatatgtaggttgatgtgttttttttttatttatgtttgtttggttttgttatatatgttgttgtgttgttggttttgaatgtgtatgagtggtttgtgttggggttagtggaggtt

SEQ ID NO: 14871 - DNA, 234 bp, Artificial Sequence
  Description of Artificial Sequence: Synthetic polynucleotide
aggggttatatttatggatttttttttttttggtaggaagatgagtgattatatttttgttattattgaattgagtgttttgtttgtttggtgttagtattgtttgtattattattttgattttatttattattgtttggtggatgggtggaggttttggtaggtttgtgatatggtgtattattttattattgaagttatttaggaatggtggtgggtattgtgttagtaggg

SEQ ID NO: 14872 - DNA, 201 bp, Artificial Sequence
  Description of Artificial Sequence: Synthetic polynucleotide
ggggttttttgtttttagtattgttagtttaggtgtgttttttatggtgtgatgtgtttgtagatttggaaatattataggatttaggtattttatggagtgtttgttttgtgttagttttagtttagtgttttttagatattgtttgattttttggaggtagttattgatattgtgtttattgtatagatgagaaagttg

SEQ ID NO: 14873 - DNA, 201 bp, Artificial Sequence
  Description of Artificial Sequence: Synthetic polynucleotide
tttttagtgagatgaatttggtattttagatggaaatgtagaaattatttgttttttgtgttgtttatgttgggagttgtagattggagttgtttttatttggttattttggttttttttttttgttttttttttgagatagtgtttttttttatttttgttatttaggttgtagtgtagtggtgtggtttgtgtttattg

SEQ ID NO: 14874 - DNA, 201 bp, Artificial Sequence
  Description of Artificial Sequence: Synthetic polynucleotide
taattttattttgtttttgagatagagttttgttttgttgtttaggttggagtgtagtggtgtaattttggtttattgtaagttttgttttttgggtttatgttatttgtttgttttagttttttgaataattgggattataggtgtttgttattatgtttggttaaatttttgtatttttagtagagatggggttttatc

SEQ ID NO: 14875 - DNA, 201 bp, Artificial Sequence
  Description of Artificial Sequence: Synthetic polynucleotide
atttttagggttgtggatggtagaattaaaagagttaattagtaagtagaattgttttttttggggttttaaggtttgagtattttttttggggtgttattgtattttttttggggtgatatgtttggtttagttgtaagttttgtttagaatttgtttgtgtattggtgtttggaatagttagttggattttatatttat

SEQ ID NO: 14876 - DNA, 201 bp, Artificial Sequence
  Description of Artificial Sequence: Synthetic polynucleotide
ggtttttgtagggagtttatattagtagttttttattttgaggagatatgtgggttttttttttgaagtttgtttaggaggtagatggagtgatttgatttggaggataggagggtgtttaggggttttggtgttatagtttttataggatgattttggagtgtttttggattttgagttgttttggttaaggagttgtat

SEQ ID NO: 14877 - DNA, 201 bp, Artificial Sequence
  Description of Artificial Sequence: Synthetic polynucleotide
tatatataggtgtggatatttatatggtttttggtagtgttgtaggaggttagtatagagatgtgttgaggagtttgagatgtttgtttttttgggttattgtgtgtaaaggttgtttttgttgtggatttttatatgtgtgatatatatgaataggtgaaatggatatgtatggtttttatatatgtgagttgggttttt

SEQ ID NO: 14878 - DNA, 201 bp, Artificial Sequence
  Description of Artificial Sequence: Synthetic polynucleotide
tttttgtgaaggtattaagtatggtagatgtttttatattgttggggtttgtttttttgtggatgggaagtgggaatgtgatgtggatgtgatgtgggaatgtaatgtgatgtgatgtgatgtgatgtggtatggtgtgaggatagtgtggtgggagtggtgttttagatttagtagggagggagatgaaaggtggatgga

SEQ ID NO: 14879 - DNA, 201 bp, Artificial Sequence
  Description of Artificial Sequence: Synthetic polynucleotide
gttgggtgtggtggtatgtgtttgtagttttagttatttaggaggttgaggtaggagaattttttgaatttgggatgtagaggttgtagtgagttgagattgtgttattgtattttagtttggtaatagagtgagattttggtttaaaaaaaaaaaaaaagaaaaaaaaaaaaaaaagaaggagttgaggttttaagaatt

SEQ ID NO: 14880 - DNA, 201 bp, Artificial Sequence
  Description of Artificial Sequence: Synthetic polynucleotide
ttgtattttgtgggtaggggatattttttttagtggttggtgatgattgtgattttatttgttgagttttgtgggagttttggtagttttttgtaattgttggttggttgttattgttttagtgtttgttttttgattggttagtaaattatggtggtagatagaaaaaagatagtttttttttttagggttgttttataa

SEQ ID NO: 14881 - DNA, 201 bp, Artificial Sequence
  Description of Artificial Sequence: Synthetic polynucleotide
ttttgttggtgtattttgttggtgtattttgttggtgtattttgttggtgtattttgttggtgtattttgttggtgtattttgttggtgtattttgttggtgtaagttgtgttttgggattgggtttgaaaagggaggagttatttattttaagtttttaggtttggggagaattttatagtaagttttttgggagtttga

SEQ ID NO: 14882 - DNA, 686 bp, Artificial Sequence
  Description of Artificial Sequence: Synthetic polynucleotide
gtggtatttgtaggtttttaggattaggtagaggatttagtttttttaggattggggttttggtgttgtgttttaggggaggttgatgggggttgggaggtgtttagggtgggaatttagtgtatgggtgaggattttaaaaagtaaggggtaggatgagttaataaggttttgagtaggaaaattatgtgataggaagtgtatatattgttttatagtagaaagattggggatgggattagtttttaagtgattttaaatttaaaaggaagtaatttttagatttttatgggtgttttaatttgttttgggtgaaggaagataggtaagaatttttaggtttgtgaggattttatgttttagggatagaagtgttagggatttgggaagtgtagatttaatataaggtagagtaaaatttatgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtggggttgggattagatttgtgtatttttttgttttgtatttagtgtttttgttttttgggtgtttggaggtgagagtggttaggaaggttgaggtatgat

SEQ ID NO: 14883 - DNA, 201 bp, Artificial Sequence
  Description of Artificial Sequence: Synthetic polynucleotide
gttagagtgtagtggtgtgattttggtttattgtaagttttgttttttgggtttatgttatttttttgttttagtttttttagtagttgggataggggtatgttgttatgtttggttagtttttgtatttttagtagagatggggttttattatattagttaggatggttttgattttttgattttgtgatttgttagttt

SEQ ID NO: 14884 - DNA, 201 bp, Artificial Sequence
  Description of Artificial Sequence: Synthetic polynucleotide
gttagagattttgtttttaaaagtaaaaaagaaaaaaaaagtttttttttaagttattatatattttgaataattaatattgaaaattgttggttgggtgtggtggtttatgtttgtaattttagtattttgggaggttgaggtggggtggattatgagattagtagaatggtgtgaatttggaaggtggagtttgtagtg

SEQ ID NO: 14885 - DNA, 201 bp, Artificial Sequence
  Description of Artificial Sequence: Synthetic polynucleotide
ttgtatttttatttgaggtattgggtttattttattagggagtgttagatagtgggtgtaggttagtgggtgtgtgtattgtgtgtgagttgaagtagggtgaggtattgttttatttgggaagtgtaaggggttagggagttttttttttgagttaaagaaaggggtgatggatgtattttgaaaattgggttattttta

SEQ ID NO: 14886 - DNA, 201 bp, Artificial Sequence
  Description of Artificial Sequence: Synthetic polynucleotide
atgtatttattgatttgtgtttattgtttggtagtttttagtgagatgaatttggtattttagttggaaatgtagaaattattattttttgtgttgtttatgttgggagttgtagattggagttgtttttatttggttatgttggttttttttttggatataattatttttgtatttatttaatttttatttttatggaat

SEQ ID NO: 14887 - DNA, 201 bp, Artificial Sequence
  Description of Artificial Sequence: Synthetic polynucleotide
tttttatgtgattattgtttgtttgttagtgttagttttttttgattttaaattataagtggaagaaagtatgttagaaatttatagaattggtttggtgtggtggtttaggtttgtaattttagtattttgggaggttgaggtaggtggattatgaggttaggagattgagattattttggttaatagggtgaaattttg

SEQ ID NO: 14888 - DNA, 201 bp, Artificial Sequence
  Description of Artificial Sequence: Synthetic polynucleotide
aagttttttttttttttttttttttttttttttgagatggagttttatttttttgtttaagttggattgtagtggtgttattttggtttattgtaagttttgttttttgggtttatgttatttttttgttttagttttttgagtagttgggattataggtgtttattattatgtttggttaattttttgtatttttagtag

SEQ ID NO: 14889 - DNA, 201 bp, Artificial Sequence
  Description of Artificial Sequence: Synthetic polynucleotide
tgtttggtgtatgttgtggagggtgtgggtaatggtgtatattgtattaattataaattgtattttgtttttttgtttgtaggtggagttttggttgatgtgttttttgtttgttttagggatgtttagagaaagtgtgtttggtttttatgtattgaatttggttttttgttttttttttttttatttttattatttttt

SEQ ID NO: 14890 - DNA, 201 bp, Artificial Sequence
  Description of Artificial Sequence: Synthetic polynucleotide
gattttagggggttttattttagtggttttttttattttttttgtagagaaaaaagagtgttggtgggattattgtttattgtgtgtttaggaggtgttttgtaatatggtgtattttaatgtgatttgtgatggttgtaatgggtttgtggtaggaatttgttataagtgtagtgtttgtttagattatgatttgtgtag

SEQ ID NO: 14891 - DNA, 201 bp, Artificial Sequence
  Description of Artificial Sequence: Synthetic polynucleotide
ggtattttatttatttagagatagagttttgttgtgatgtttaggttggagtgtatggtgtaattttggtttattgtaggttttgttttttgggttttagtgatttttttgttttagttttttgagtagttggggttatagttatgtgttattatgttgggttaatttttgtatttttagtagagatagggtttttttata

SEQ ID NO: 14892 - DNA, 201 bp, Artificial Sequence
  Description of Artificial Sequence: Synthetic polynucleotide
ttattatgtttaattaattttttttatttgtagtagagatagggttttattgtgttagttaggatggttttgattttttgattttgtgatttgtgtgttttggttttttaaagtgttgggattataggtgtgagttattgtgtttggtttgtaaatattttttgtgttttagtgggttatgtttttattttgttgattgtt

SEQ ID NO: 14893 - DNA, 227 bp, Artificial Sequence
  Description of Artificial Sequence: Synthetic polynucleotide
ttagttttttgagtagttggaattataggtgtttgttattatgtttggtttattttttgtatttttagtagagatggggttttattatgttagttaggattgttttgattttttgattttgtgatttgttggttttggttttttaaagtgttgggattataggtgtgagttattatgtttagttttagaaattgaaatgtatattattaagtgaaagaagttaattt

SEQ ID NO: 14894 - DNA, 201 bp, Artificial Sequence
  Description of Artificial Sequence: Synthetic polynucleotide
tttttttttagttttgttgttattttgtagtttgattttagattgttgtgttagtaattagtgagattttgagttaggtgtgggatataattttgtggtgtgttgttttttaagttggttggaaaagtgtaatatttgggtgggagtgatttgattttttaggtgtgtttgttatttttttttttgatttggaaagggaat

SEQ ID NO: 14895 - DNA, 201 bp, Artificial Sequence
  Description of Artificial Sequence: Synthetic polynucleotide
aggtgtgtttgttatttttttttttgatttggaaagggaattttttgattttttgtgttttttaagtgaggtaatgtttttttttgttttggtttgtgtatggtgtatgtttttattgatttgtgtttattgtttggtttttttaagtgagatgaatttggtattttagatggaaatgtagaaattatttgttttttgtgt

SEQ ID NO: 14896 - DNA, 201 bp, Artificial Sequence
  Description of Artificial Sequence: Synthetic polynucleotide
tgtttttttgttttagtgtttatattgtaaaaaagtgttttttttattgggtgtggtggtttatgtttgtaattttagtattttgggaggtagaggtgggtggattatgaggttaggagattgaaattattttggttaatatggtgaaattttgtttgtattgtgaatataaaaaattagttgggtgtggtggtgggtgtt

SEQ ID NO: 14897 - DNA, 201 bp, Artificial Sequence
  Description of Artificial Sequence: Synthetic polynucleotide
gttgggtgtggtggtgggtatttgtagttttagttatttgggaggttgaggtaggagaatggggtgaatttgggaggtggagtttgtagtgagttgagattgtgttattgtattttagtttgggtgatagagtgagattttattttaaaaaaaaataatattaggattgaagtttgttttttaatttttagtgatatggtt

SEQ ID NO: 14898 - DNA, 201 bp, Artificial Sequence
  Description of Artificial Sequence: Synthetic polynucleotide
tgaataagaaagggttattatattttattttgaaatggtttttggagaaagaatggaagtaaattgtataagtgggtgtttatttttttttatttggttatggttattgtggtgtttggttaggtttttggtgatgtgaggtaaatttttttgttggtaaattagtttatatattttttttattgtagatggttatttaga

SEQ ID NO: 14899 - DNA, 201 bp, Artificial Sequence
  Description of Artificial Sequence: Synthetic polynucleotide
ttaagtatttttttgtgatttgtttagaggaatttttggtagtggggatggtgttatttttatttgagagatgaggagattgaggtttagaggggggatgtggtttgtttgagttatattgattgagaggggtagatttggatttgtttgtagtttaagtttttagagattttggtgtggtttgttgggtagttagtttgt

SEQ ID NO: 14900 - DNA, 201 bp, Artificial Sequence
  Description of Artificial Sequence: Synthetic polynucleotide
gtgtgattttggaggggtaagaattattttggtagttatgggggagtttatgagtgtttgataagaggttatgtttttttgggattttttagaaagttagtggaggggttggggatagtagttgttttgggtttaaggtgagtagtattgttgtttttgaggatggtgtgtaggtgaaggtattgttgattttaggttggg

SEQ ID NO: 14901 - DNA, 201 bp, Artificial Sequence
  Description of Artificial Sequence: Synthetic polynucleotide
tttggatatttaggttatttttgaattttaaggtttttaattgtagttatatgtatagaggtttttttgttatgtggggtaatatggttatagggtaagatggttatgggttttagatatttttgggttattattttgtttattgtaggtggatatagttatggaatggaagtaatttttttgattatttatggtagtttt

SEQ ID NO: 14902 - DNA, 201 bp, Artificial Sequence
  Description of Artificial Sequence: Synthetic polynucleotide
gatttttttgagtttgttgggagatagttatgttaatggttataatgggtatagtgtttaggaatgtagtaatttagttagttgttagttttttttttggtgtgggtattatttaatgtgtttatttggggtttagatgtgataaattggttgagggattttgggttttggttgggatgagtgtagtaaatttgttgttat

SEQ ID NO: 14903 - DNA, 201 bp, Artificial Sequence
  Description of Artificial Sequence: Synthetic polynucleotide
ttttgaatagtagtaggtagtagagttttagggagagtaggtttttgtggtgtagtattatggttttgtgttttattttggagaagttgatggagatgtgtgttttggggatgggttttaggattagtttttttgtggtttggttgttgtttgggagtggttgttggtggatggtgtagtgtagaggtaggatgttggggg

SEQ ID NO: 14904 - DNA, 201 bp, Artificial Sequence
  Description of Artificial Sequence: Synthetic polynucleotide
atagggttttattttgttagttaggatggttttgattttttgattttgtgatttgttagttttggttttttaaagtgttgggattataggtgtgagttattgtattgggttggtagttattttttttaagtagtagttttattttttagtataaattaatgttgtagtttttaaattatttgttgaagtgtttttgaattt

SEQ ID NO: 14905 - DNA, 201 bp, Artificial Sequence
  Description of Artificial Sequence: Synthetic polynucleotide
ttttttttttttttttgagatagaattttgttttgttgtttaggttggagtatagtggtgtgatattagtttattgtaaattttattttttgggtttaagtgatttttttgttttagttttttgagtatttgggattatagggagtgtttttatatttggttaattttttgtatttttagtagagatagggttttattgtg

SEQ ID NO: 14906 - DNA, 201 bp, Artificial Sequence
  Description of Artificial Sequence: Synthetic polynucleotide
aatagttgggtgtggtggtttatatttgtaattttagtattttgggaggttgaggtgggtagattatgaggttaggaaattgagattattttggttagtatggtgaaattttgtttttattaaaaatataaaaaaaattagttgggtgttgtggtggatgtttgtagttttagttatttttaaggttgaggtaggagaatg

SEQ ID NO: 14907 - DNA, 201 bp, Artificial Sequence
  Description of Artificial Sequence: Synthetic polynucleotide
ttgatttggaaagggaattttttgattttttgtgttttttaagtgaggtaatgttttgttttgttttggttggtgtatggtgtgtgtatttattgatttgtgtttattgtttggttttttttagtgagatgaatttggtattttagatggaaatgtagaaattatttgttttttgtattgtttatgttgggagttgtagat

SEQ ID NO: 14908 - DNA, 201 bp, Artificial Sequence
  Description of Artificial Sequence: Synthetic polynucleotide
tttttattttgttttttagatagaattttgttgtgttatttaggttggagtgtagtggtgtgattttggtttattgtaatttttgttttttgggtttatgtgatttttttgttttagttttttaagtagttgggattgtaggtgtgtattattatgtttatattaagtttttgtatttttagtagagatggggttttgtta

SEQ ID NO: 14909 - DNA, 201 bp, Artificial Sequence
  Description of Artificial Sequence: Synthetic polynucleotide
tagtgaaattttgtttttattaaaaatataaaaaattagtttggtgtggtgaagggtatttgtagttgtagttatttaggaggttgaggtaggagaatggtgtgaatttgggaggtggagtttgtagtgaattgagattatgttattgtattttagtttgggtgatagagtgagattttgttttaaagaaatagaagattt

SEQ ID NO: 14910 - DNA, 201 bp, Artificial Sequence
  Description of Artificial Sequence: Synthetic polynucleotide
ttttgtgaaaaataaaaaaaataagttgggtgtggtggtttatgtttgtaattttagtattttgggaggttgaagtaggtagattatgaggttaggagattgagattattttggttaatgtggtgaaattttgtttttattaaaaatataaaatattagttgggtgtagtggtgggtgtttgtagttttagttatttggga

SEQ ID NO: 14911 - DNA, 201 bp, Artificial Sequence
  Description of Artificial Sequence: Synthetic polynucleotide
gagttaaagtgatatgtttgtttgggttttttaaagtgttggaattatagatttgagttattgggtttagtttaattattttttttagtttgagtatgagtgttggaagaaaagtttttatttgtatttattttttttagatatagggtttttttttgttatttaggttggagagtagtggtgtaatttttgtttggttta

SEQ ID NO: 14912 - DNA, 201 bp, Artificial Sequence
  Description of Artificial Sequence: Synthetic polynucleotide
ggagtatgaggtaggagagttatttgaatttgggaggtagaggttgttgtgagttgagattatatttttttattttagtttgagtggtagagtaagattttgttttaaaaaaaaaaaaaaaaagttgggggaaggagagaaaaatagagagtttagtggggtaattttttatttagtttttgttatttgttattgttttag

SEQ ID NO: 14913 - DNA, 201 bp, Artificial Sequence
  Description of Artificial Sequence: Synthetic polynucleotide
atatttggtttttgggatttgtatatttttgttttttttgggtggaaagatggtttttttgattagggtttttttgtgttttagagggtatgtttttttttgtaagtgtgagttgtatattagtgagtatgtgtttttatttttagggatattggttattaggtttggggttagatggtaggatttttgttttttttttta

SEQ ID NO: 14914 - DNA, 201 bp, Artificial Sequence
  Description of Artificial Sequence: Synthetic polynucleotide
ttataggtgtttgttattatgtttggttaattttttgtgttttgtttagtagagatggggttttattgtattagttaggatggttttgatttgttgattttgtgatttgtttgttttggttttttaaagtgttgggattataggtgtgagttattttgtgtttggtttttttatttttatattttaaattagagatgattt

SEQ ID NO: 14915 - DNA, 217 bp, Artificial Sequence
  Description of Artificial Sequence: Synthetic polynucleotide
tataggtgttttttattatgtttggttaattttttgtatttttagtagagatggggttttattgtgttagttaggatggttttgattttttgattgagattgtgtttttttgattgtgtttggttgattttttttttttttttatttgttttttttttttttattattattaaaagtttattgttttatatttttttttttttaattttatttaaaa

SEQ ID NO: 14916 - DNA, 217 bp, Artificial Sequence
  Description of Artificial Sequence: Synthetic polynucleotide
ggtttatagtttttagtttgagtgatgtagaagatgggtgatttttgtatttttatttgaggtattgggtttattttattagggagtgttagatagtgggtgtaggttagtgagtgtgtgtattgtgtgtgagttgaagtagggtgaggtattgttttatttgggaagggtaaggggttagggagtttttttttttagttaaagaaaggggtgatgg

SEQ ID NO: 14917 - DNA, 201 bp, Artificial Sequence
  Description of Artificial Sequence: Synthetic polynucleotide
gtttgttattatgtttggttaaatttttgtatttttagtagagatggggttttattttgttaattaggatggtgttgattttttgattttgtgatttgtttgttttggttttttaaagtgttgggattataggtgtgagttattgtgtttggtttggaaattgttttttatgtagttgatttattttaatttttattagta

SEQ ID NO: 14918 - DNA, 201 bp, Artificial Sequence
  Description of Artificial Sequence: Synthetic polynucleotide
tatatgattttgaataagttttgaattatttatatgtgattttttggttttatatgaggtagaatagtatggtgtggattgggaattttgatgtgggagttgaaagatggggaggttgtgggtatggtttttggagttttgggattgagatatgtaggtattttagatgggtttgttgttataataagtgggaaattttta

SEQ ID NO: 14919 - DNA, 201 bp, Artificial Sequence
  Description of Artificial Sequence: Synthetic polynucleotide
tttagagaagatttggtagtttttttagtttttggtttttgtttttgttttttttttttttgtttttaggttttttttttgtagttttttagttttttattgtgttttgtgtttttggttttttttttttttagtgttttttttatttggtgttgtttggttgtaattttggtttttttggggaagaggtttggattttat

SEQ ID NO: 14920 - DNA, 201 bp, Artificial Sequence
  Description of Artificial Sequence: Synthetic polynucleotide
tgtttttatattggaaaaatttaaatatttttaagagtttgattattggttgggtgtggtggtttaatgtttgtaattttagtattttgggaggttgaggtggttggattataaggttaggagattgtgattattttggttaatatggtgaaattttgattttattaaaaaaatataaaaaaattagttgggtgtggtggc

SEQ ID NO: 14921 - DNA, 201 bp, Artificial Sequence
  Description of Artificial Sequence: Synthetic polynucleotide
gatttggttgtttagaagtgtgtgttattttggattgagttaagatggttgaataggaatagttttggtttatagtttttattgtgagtgatgtagaagatgggtgatttttgtatttttatttgaggtattgggtttattttattagggagtgttagatagtgggtgtaggttagtgggtgtgtgtattgtgtgtgagtt

SEQ ID NO: 14922 - DNA, 201 bp, Artificial Sequence
  Description of Artificial Sequence: Synthetic polynucleotide
ttttggttgggtgttgtggtttatgtttgtaattttagtgagaggtgatagtatgttggtagtttttgtagtttttttttattagtgtgatttttgggtgtgtgtgggttgggttggtttgtatttggagtggttagtagttttgggtagtgaggggtttagtatttgggttagtagttgttgtgtttgattttttgttag

SEQ ID NO: 14923 - DNA, 201 bp, Artificial Sequence
  Description of Artificial Sequence: Synthetic polynucleotide
tgtggttgggtgtggtggtttatttttgtaattttagaattttgggaggttgaggtgggtggattatgagattagtagattgagattattttggttaatatggtgaaattttgtttttattaaaaatatagaaaaagtagttgggtgtggtggtgggtatttgtagttttagttataggttgaggtagaagaatggtgtga

SEQ ID NO: 14924 - DNA, 201 bp, Artificial Sequence
  Description of Artificial Sequence: Synthetic polynucleotide
ttttggttttttaaagtgttggggttataggtgtgagttattgtgtttggttagttgtttttattaaaaatataaaaaattagtttggtgtggtggtgggtgtttgtagttttagttattttggaggttgaggtaggggaattgtttgaatttatgaggtggaggttttaagttgaggttgtgttattgtattttagtttg

SEQ ID NO: 14925 - DNA, 201 bp, Artificial Sequence
  Description of Artificial Sequence: Synthetic polynucleotide
ggttggagtgtagtggtgtgattttggtttgttataatttttattttttagtagtttgttttggttttttaaagtgttgagattgtagtttttgtttggttgttattttgtttgagaagtgaggagtgtttttgtttggttgttattttatttaggaagtgaggagtgtttttttttggttgttattttatttgggaagtg

SEQ ID NO: 14926 - DNA, 201 bp, Artificial Sequence
  Description of Artificial Sequence: Synthetic polynucleotide
gttttagttgtttttttgtggggtagggtttgggatttgtagtttgttatgtttgagttttttattttttttgtgggtttttgtgtggtttgagtttttttgatgagtgttattttttgttttatggtatttagttttattgattatttaagggttgaggagtgtgggtgtatagtattgggattggtaggtagttttatt

SEQ ID NO: 14927 - DNA, 286 bp, Artificial Sequence
  Description of Artificial Sequence: Synthetic polynucleotide
gaagatgggtgatttttgtatttttatttgaggtattgggtttattttattagggagtgttagatagtgggtgtaggttagtgggtgtgtgtattgtgtgtgagttgaagtagggtgaggtattgttttatttgggaagtgtaaggggttagagagttttttttttgagttaaataaatgggtgatggatgtatttggaaaattgggttatttttatttgattattgtgttttttagattggtttaaaaaatggtgtattatgagattatattttatatttggttc

SEQ ID NO: 14928 - DNA, 201 bp, Artificial Sequence
  Description of Artificial Sequence: Synthetic polynucleotide
gttttagttgtttttttgtggggtagggtttgggatttgtagtttgttatgtgtgagtttttttttattgttttaggtttttgtgtagtaggagtttttttgatgagtattgttttttgttttatggtatttggttttattgattgtggaatggttgaggagtgtgggtataaggtatgggattggtaggtagttttgttt

SEQ ID NO: 14929 - DNA, 201 bp, Artificial Sequence
  Description of Artificial Sequence: Synthetic polynucleotide
ggagtgtaatggtattattttggtttattgtaatttttgttttttgggtttaggtgatttttttgttttagttttttgagtatttgggattataggtgtgtgtttttatgtttaattaatttttgtatttttagtagagatggagttttattatgttggttaggtttgttttgaatttttgattttgtgatttatttgttt

SEQ ID NO: 14930 - DNA, 201 bp, Artificial Sequence
  Description of Artificial Sequence: Synthetic polynucleotide
tttttgttatttttttttttgatttggaaagggaattttttgattttttgtgttttttgagtgaggtaatgttttgttttgttttggtttgtgtatattgtgtatatttattgatttgtgtttattgtttggtattttttagtgagatgaatttggtattttagatggaaatgtagaaattatttgttttttgtgttgttt

SEQ ID NO: 14931 - DNA, 201 bp, Artificial Sequence
  Description of Artificial Sequence: Synthetic polynucleotide
gatgtagaagatgggtgatttttgtatttttatttgaggtattgggtttattttattagggagtgttagatagtgggtgtaggtttgtgggtgtatgtattgtgtgtgagttgaagtagggtgaggtattgttttattttggaagtgtagggggttagggagtttttttttttagttaaagaaaggggtgatagatggtat

SEQ ID NO: 14932 - DNA, 201 bp, Artificial Sequence
  Description of Artificial Sequence: Synthetic polynucleotide
tttagttaattttttttatatttttaatagagatagggttttattatgttggttaggatagttttgattttttgattttgtgatttgtttgttttggttttgtaaagtgttgggattataggtgtgagttattgtatttggttggaagtatatattttaatagttttatatagtagttgttgttagaatttaaatgaagat

SEQ ID NO: 14933 - DNA, 201 bp, Artificial Sequence
  Description of Artificial Sequence: Synthetic polynucleotide
tagaagatgggtgatttttgtatttttatttgaggtattgggtttattttattagggagtgttagatagtgggtgtaggttagtgtgtgtgtgtattgtgtgtgagttgaagtagggtgaggtattgttttatttgggaagtgtaaggggttagggagttttttttttgagttagggaaaggggtgatggatggtatttgg

SEQ ID NO: 14934 - DNA, 201 bp, Artificial Sequence
  Description of Artificial Sequence: Synthetic polynucleotide
ttggtagggttggttggttgtttttagtgtggggtttgttaagtttatgtttatttggaattttagttggtttgtaagtattatgtatagtttgggtttttgtttatgtttttttatttatatttttttgtaagttgagggagtgggttttggttttggttagtttagaaaggggtttttatagtgtagtggtgggttgaa

SEQ ID NO: 14935 - DNA, 201 bp, Artificial Sequence
  Description of Artificial Sequence: Synthetic polynucleotide
tttgagatttttgtagttttggggtttgagttgaggggttattggtagtgttgtgggagttaggttgtttttttggaagttaggttgtttttgagtagagtggaggttttattgttttttggggggtatggtggtagtttttaggttgtattggggttggatgagttgggggtggagtataaggggttagttttttttttt

SEQ ID NO: 14936 - DNA, 201 bp, Artificial Sequence
  Description of Artificial Sequence: Synthetic polynucleotide
aaattttttgtttgtagggggtgggtggggaggtggaggaggggttgggttaaatgttgggggtgtgatttggggttgtgggtttttgggttttagtttttgggtttgttgagtgggtgagtggggtgttttattttttgtggtttttttttggtttttatagaatatggagaaggtgattttgttgttggtgatgtttat

SEQ ID NO: 14937 - DNA, 201 bp, Artificial Sequence
  Description of Artificial Sequence: Synthetic polynucleotide
gggtgtttgtagttttagttatttgggaggttgaggtaggagaatggtatgaatttgggaggtggagtttgtagtgagttgagattgtgttattgtattttggtttgggtgatagagtgagattttgttaaaaaaaaaaaaaaaaagtagttttgtaagattaggtgtttggtagataggtatatttagtaaagttataat

SEQ ID NO: 14938 - DNA, 210 bp, Artificial Sequence
  Description of Artificial Sequence: Synthetic polynucleotide
ttattaaaaatataaaaaaattagtttggtgtggtggtgggtgtttttagttttagttgtttgggaggttgaggtaggagaatggtgtgaatttgggaggtggagtttgtggtgagttgagattttgttatagtattttagtttgggtgatagagtgagattttgttttagaaaaaaaaaaaaaaaaaaaaaagaagtgggaatttagaa

SEQ ID NO: 14939 - DNA, 201 bp, Artificial Sequence
  Description of Artificial Sequence: Synthetic polynucleotide
ttttgggtttatgttatttttttgttttagttttttgagtagttgggattataggtatttggttaattttttgtattttttatagagatggggtttttattgtgttagttaggatggttttgattttttgattttgtgatttgtttgtttgggttttttaaagtgttgggattataggtgtgagttattgtgtttagtttg

SEQ ID NO: 14940 - DNA, 201 bp, Artificial Sequence
  Description of Artificial Sequence: Synthetic polynucleotide
gattgtttttttgttattgtatttatataatttgttttaaatgggtaatttattaagtatattttgtttttgtttttgttgtaggtttttgttggattgttgtttataagtttttatagtttgtgagtttttttagtttggtttggtttattttgtggtgtttatgtttattttgggttttttttgatttttttttaattt

SEQ ID NO: 14941 - DNA, 201 bp, Artificial Sequence
  Description of Artificial Sequence: Synthetic polynucleotide
gtagtgtagtggtgtaattttggtttattgtaagttttgttttttgggtttatgttatttttttgttttagtttttgggttagttgggattataggtgtttgttattgtgttaggttaattttttgtatttttagtagagatggggttttattatattagttaggatggttttgattttttgattttgtgatttatttgtt

SEQ ID NO: 14942 - DNA, 201 bp, Artificial Sequence
  Description of Artificial Sequence: Synthetic polynucleotide
tttgtgttttttttttttgagttggtgggttatagatgttggaagaaatttttgtatttgtagttggaattgtagtttatggtgttttggtttttttttttgttttgtttttttttggttaaataatatattaaagaggtgaggtaatgattgttggttagtttttattggggaaaaatttattgttaggatggtatgaat

SEQ ID NO: 14943 - DNA, 201 bp, Artificial Sequence
  Description of Artificial Sequence: Synthetic polynucleotide
ggaataaatatttttgttttataaagatttagaatttattggatattgataaaatgtttattagaggttggtgtagtggtttatgtttataattttggtgtggtggtttatatttgtaattttgatgtggtggtttatatatgtaattttagtattttgtaaggttaggtggggggattatttgagtttaggagtttatga

SEQ ID NO: 14944 - DNA, 201 bp, Artificial Sequence
  Description of Artificial Sequence: Synthetic polynucleotide
gtggtgtaattttggtttattgtaagttttgttttttgggtttatgttatttttttgttttaggtttttgagtagttgggattataggtgtatattattatgtttggttaatttttttgtatttttagtaaagatggggttttattatgttagttaggatggttttgattttttgattttgtgatttattagttttagttt

SEQ ID NO: 14945 - DNA, 201 bp, Artificial Sequence
  Description of Artificial Sequence: Synthetic polynucleotide
gtaaattttttgtaaaattttggttttttagattttagttgggtttttttttttaggtttttagtggtagttgtgttttttgtgtgtttatgttggttagtgtaagttatatatggatttagtgtttattgtatttttgttagttttagggttttagtttgttgttttgggagattttagttttggtttaggtattttttt

SEQ ID NO: 14946 - DNA, 201 bp, Artificial Sequence
  Description of Artificial Sequence: Synthetic polynucleotide
ttttaatttttttattaagatggagttttgttttattgtttaggttggagtgtagtggtgtgattatggtttattataatttttgttttttgggtttaagtgatttttttgttttagttttttgagtagttgggattataggtatgtgttattatgtttaggtaattttagtatttttagttgagatggggttttattatg

SEQ ID NO: 14947 - DNA, 201 bp, Artificial Sequence
  Description of Artificial Sequence: Synthetic polynucleotide
ttttgttaggtgtggtggtttatgtttgtaattttagtattttggaatgttgaggtaggtgaattatgaggttaagagattgagattatttttgttaatatggtgaaattttgtttttattaaaaatataaaaaattagttgggtgtgggggtgggtgtttgtagttttagttgtttgggaggttgaggtaggagaattgt

SEQ ID NO: 14948 - DNA, 201 bp, Artificial Sequence
  Description of Artificial Sequence: Synthetic polynucleotide
attattttttttttttttgagatggagttttgttttgttgtttatgttggggtgtagtggtatgattttggtttattgtaagttttgttttttgggtttatgttatttttttgttttaattttttgagtagttgggattataggtatatgttattatatttggttaatttttttgaatttttagtagagaggggttttatt

SEQ ID NO: 14949 - DNA, 201 bp, Artificial Sequence
  Description of Artificial Sequence: Synthetic polynucleotide
tttgtgaatttgggtggtgttttttttttgtattatttagatgtgtttttaggaaggatgtgttgttatgatttgttatggtggttttggggatggttagtggtgggatgatgggtgtgatgtggttttggggatggttagtggtaggatgatgggtgtgatgtatttgtgttatttgggatttaaatttatttatgattt

SEQ ID NO: 14950 - DNA, 201 bp, Artificial Sequence
  Description of Artificial Sequence: Synthetic polynucleotide
attgggttttattgtgttagttaggatggttttgattttttgattttgtgattagtttgttttggttttttaaagtgttggtattataggtgtgagttattgtttttggtaaagtttttttttgatggttttagtttgttggataagttaggaataaggttattggttgtaagggaggaggagtttttgtaggtggtagtg

SEQ ID NO: 14951 - DNA, 201 bp, Artificial Sequence
  Description of Artificial Sequence: Synthetic polynucleotide
ggtgatttaaattgtttatgtggaatatatatatatatatatatatatatatatatgtgttttagggatggatatatataaatatgtgttttaggggttttgtgtgaggagaggagatttatattattgatttagtaattagggttgattttagagggttggagtatatattttgggttgatgataggtgtttggttttgg

SEQ ID NO: 14952 - DNA, 201 bp, Artificial Sequence
  Description of Artificial Sequence: Synthetic polynucleotide
ttttggtttgtttttttttattttaggttgttttaatttttttttgaaagtttggtgtttattttttattttttgggaaatattttgttgttttggggtgtgttttgtgaaggagatatgttgggtgaaagttagggattttataattattttttgtttttattttgggtttagtgtaggggttgttgtgaaggtattggt

SEQ ID NO: 14953 - DNA, 201 bp, Artificial Sequence
  Description of Artificial Sequence: Synthetic polynucleotide
aggttgttgggaaggaattggtttttatggaagtgttttagtttttttgtttttttggttttttttttttggttgttttagtgttttattgaaagtttggtgttatatttttattttttgggaaattttatgtttttttggggtgttttttgtggggaagatatgtattttgggtgaaagttagggattttatgaatattt

SEQ ID NO: 14954 - DNA, 201 bp, Artificial Sequence
  Description of Artificial Sequence: Synthetic polynucleotide
attaatttaaatatttattaatgatagattggataaagaaaatgtggtggggtggagttaagatggttgaataggaatagttttggtttatagtttttagtgtgagtgatgtagaagatgggtgatttttgtatttttaattgaggtaatgggtttattttattggggagtgttggatagttggtgtaggatagtgggtgt

SEQ ID NO: 14955 - DNA, 201 bp, Artificial Sequence
  Description of Artificial Sequence: Synthetic polynucleotide
gtttgttattatatttggttaattttttgtatttttaatagagatggggttttattgtgttagtaaggatggttttgattttttggttttgtgatttgtttgtgttggttttttgaagtgttgggattataggtatgagttattgtgtttggttagaagtgtttttatttgtttgggaagttgtttttttttggtatttgt

SEQ ID NO: 14956 - DNA, 201 bp, Artificial Sequence
  Description of Artificial Sequence: Synthetic polynucleotide
ttttttattttaaggaataagtttttaattagattagatatagttataagtaaatataaattatgtttttatgtaattttaagagttattttaggttgggtgtggtggtttatgtttgtaattatagtatttttggaggttgtggtgggtggattatgaggttaggagattgagattattttggttaatatggtgaaatta

SEQ ID NO: 14957 - DNA, 201 bp, Artificial Sequence
  Description of Artificial Sequence: Synthetic polynucleotide
ggttaattaggggtatgtttttttatgtatatggtgggtatttttattttagttggttggtagtggtattgtatatggtattttatatttgtattttttttgttttggtttagtgtggttagggatgggttttgttagtttgtagtgttatttgttttgtgtaaggtttagaattgtttatttatgtaagttgggagtttg

SEQ ID NO: 14958 - DNA, 366 bp, Artificial Sequence
  Description of Artificial Sequence: Synthetic polynucleotide
tgagtgatgtagaagatgggtgatttttgtatttttatttgaggtattgggtttattttattagggagtgttaggtagtgggtgtaggttagtgggtgtgtgtattgtgggtgagttgaagtagggtgaggtattgttttatttgggaagtgttaggggttagggagttttttttttgagttaaggaaaggggtgattgatgtatttagaaaattgggttatttttatttgaatattgtgttttttagattggtttaaaaaatggtgtattatgagattatattttatatttggtttggagggttttatgtttatggaattttattgattgttagtatagtagtttgagattaaattgtaaggtgg

SEQ ID NO: 14959 - DNA, 201 bp, Artificial Sequence
  Description of Artificial Sequence: Synthetic polynucleotide
ataaaggttttttaagtttatattagatttatgagtttagttggttttatttagtggattttgtattgggggttgtaggtggagttgtttgttagttttgtgtagtgtttttatagtttttagtttttgggtggttgatgggattgggtgttgtggagtagggggtagtgtttattggggaggtttggttttgtaggagtt

SEQ ID NO: 14960 - DNA, 201 bp, Artificial Sequence
  Description of Artificial Sequence: Synthetic polynucleotide
ggtgttgtttgttatttttttttttgattaggaaagggaattttttgattttttgtgtttttggagtgaggtaatgttttgttttgttttggtttgtgtgtggtgtgttgtatttattgttttgtgtttattgtttggtattttttagtgagatgaatttggtattttatatggaaatgtagaaattatttattttttgtg

SEQ ID NO: 14961 - DNA, 201 bp, Artificial Sequence
  Description of Artificial Sequence: Synthetic polynucleotide
gttgttttgtagtttgattttagattgttgtgttagtaattagtgagattttgtgggtataggattttttgagttaggtgtgggatataatttttaggtgtgttgttttttaagtttgttggaaaagtgtagtattttggttggagtgatttgattttttaggtgttgtttgttatttttttttttgattgggaaagggaa

SEQ ID NO: 14962 - DNA, 384 bp, Artificial Sequence
  Description of Artificial Sequence: Synthetic polynucleotide
ttgaattgttttaattttaagtggtttagttttaagttttgtgagagtattattggttagggtttgtagattgtggttgttaattgttttgatttttagatgttgaatgtttaggattgtgaggtttttgtggaggttttgtgttttgttaaatgttattgtaagtgttgtgttattgagtatattaatttggtttttttttgaagggatagagtttatttggtgttgtatttatataaatttgaataaagtaaatttttttaaaagtagtgtatgtaagtattgatatttatttaaaatagtttttttttttgggaaggttattaggaatttggtttttatttttttttattttttatgggtaatagaggttaaagaaatgaa

SEQ ID NO: 14963 - DNA, 216 bp, Artificial Sequence
  Description of Artificial Sequence: Synthetic polynucleotide
gaagatgggtgatttttgtatttttatttgaggtattgggttaattttattagggagtgttagatagtgggtgtaggttagtgggtgtgtgtattgtgtgtgagttgaagtagggtgaggtattgttttatttgggaagtgtaaggggttagggagttttttttttgagttaaagaaaggggtgatggatgtagttggaaaattgggttattttta

SEQ ID NO: 14964 - DNA, 334 bp, Artificial Sequence
  Description of Artificial Sequence: Synthetic polynucleotide
tgatatagaagatggtgatttttgtatttttatttgaggtattgggtttattttattagggagtgttagatagtgggtataggttagtgggtgtgtgtattgtgtgtgagttgaagtagggtaaggtaatgttttatttgggaagtgttaggggttagggagtttttttttttagttaaagaaaggggtgatggatgtatttggaaaattgggttatttttatttgaatattgtgttttttggattggtttaaaaaatggtgtattatgagattatattttgtatttggtttggagggttttatttgatggagttttgttgattgttagtatag

SEQ ID NO: 14965 - DNA, 201 bp, Artificial Sequence
  Description of Artificial Sequence: Synthetic polynucleotide
gggattttaaggttttgttggtgtggtttaaaggtattggatgttggggttaagatgatttttgtgttgttatgaattaggttattggatgtgggttttgtgttgagtttgtagtttttgaggagttttttgggtttttttgttttgattatatttttttggatggttgttgggtttttgtttgttttgttttgtattgag

SEQ ID NO: 14966 - DNA, 270 bp, Artificial Sequence
  Description of Artificial Sequence: Synthetic polynucleotide
gttattgtattttagtatgggtgatagagttagtttgaaattttgttttgtgtttttttgagaagtgatagtgtattggtatggtagtttttatagtttttgtttgtttttggtgtttttttggttttggtatttattttggttgtgtttgaggagttttttagtttgttgttgtattgtggaagtttatttttgggttggttaaggttggagttggtttttttagtttgtggggaggtgtggagggagaggtatgggtgggaattgggg

SEQ ID NO: 14967 - DNA, 253 bp, Artificial Sequence
  Description of Artificial Sequence: Synthetic polynucleotide
tgtgagtgatgtggaagataggtgatttttgtatttttatttgaggtattgggtttattttattagggagtgttagatagtgggtgtaggttagtgggtgtgtgtattgtgtgtgagttgaagtagggtgaggtattgttttatttgggaagtgtaaggggttagggagttttgtttttgagttaaagaaaggggtgatggatgtatttggaaaattgggttatttttattggaatattgtgtttttttgatc

SEQ ID NO: 14968 - DNA, 204 bp, Artificial Sequence
  Description of Artificial Sequence: Synthetic polynucleotide
ttttagtaggggtggttgggtagaggtgttttttattttttggatggggtggttggttgggtaggggggttgattttttttattttttttttggatggggtggtggtaaagattgagatagttttgttgtttgttgaattttatttttttggttaaaattaagttttttaataaagattttgaagtgttgagtttattaattta

SEQ ID NO: 14969 - DNA, 228 bp, Artificial Sequence
  Description of Artificial Sequence: Synthetic polynucleotide
gttattttgtagtttgattttagattgttgtgttagtaattggtgagattttgtgggtgtaggattttttgagttaggtgtgggatatagttttttgatgtgttggtttttaagtttgtaggaaaagtgtagtatttgggtgggagaggtttgattttttatgtgttgtttgttatttttttttttgattaggaaagggaattttttgattttttgtgttttttgagt

SEQ ID NO: 14970 - DNA, 217 bp, Artificial Sequence
  Description of Artificial Sequence: Synthetic polynucleotide
tgtaggatgtagattgtagatgtttattgttttgtaggtagttttagtttgagtggtggttgtgttgggtttgtgtttggggtttttttttgtatgtttttgttttttagtgtttgtgatgatgtgtgatttattaattatttggatttagtgtatttttatgttaaatagtgtgtgtttatttgtaaagtatatgatagtttttgtggttattggg

SEQ ID NO: 14971 - DNA, 201 bp, Artificial Sequence
  Description of Artificial Sequence: Synthetic polynucleotide
ttatttttgaagttattgagattataagtttattggaaggaattaattttggatatattttgggtgtttgtttgggatattgttatatggtgagtattattggatttgtttgggatattgttatatggtgagtatttttggatttgttttattttttattttgttttatttttttttagaatttaggggttaaatattgga

SEQ ID NO: 14972 - DNA, 204 bp, Artificial Sequence
  Description of Artificial Sequence: Synthetic polynucleotide
aagataataaattggttttaaataaaaagtaagaaaaatgttggggaggagttaagatggttaaataggaatagttttggtttatagtttttagtgtgagtgatgtggaaaatgggtgatttttgtatttttattggaggtattgggtttattttattagggagtgttagatagtgggtataggttagtgggtgtgtgtattgt

SEQ ID NO: 14973 - DNA, 223 bp, Artificial Sequence
  Description of Artificial Sequence: Synthetic polynucleotide
tagtgggtatatagaggtagttgggatttgtttggaagagtttttgtttggggtaaggagttgggattgtgtttaggaggtagtggggagttttggagagtgaagtgttttttgtgtagatttgtgtgtttggagtattggagtttgtagggtaagagagggtttttagaagatttatgatgttttattgggatgtagagggaaatggttatttgtattttta

SEQ ID NO: 14974 - DNA, 201 bp, Artificial Sequence
  Description of Artificial Sequence: Synthetic polynucleotide
tttaaagtattaggattataagtagaattattgtgttttttgtttttttttttgtttttgtttttgttttgttgttgttgttgatgttgttatagagttttgtttttgttgtttaggttgggatgtaatggtgtgattttggtttattgtagtttttgttttttggttttaagtaatttttttgttttagttttgtgagta

SEQ ID NO: 14975 - DNA, 203 bp, Artificial Sequence
  Description of Artificial Sequence: Synthetic polynucleotide
agtataaataaattggttgggtggtagttttagttatttgggaggttgaggtagtagaatagtgtgaatttgggaggtggagtttgtagtgagttgagattgtgttattgtattttagtttgggtgatagagtgagattatgttttaaataaaaaaaaaaaaaaaaaaaaaaagtatttttttagatttagtttgatattagg

SEQ ID NO: 14976 - DNA, 201 bp, Artificial Sequence
  Description of Artificial Sequence: Synthetic polynucleotide
ttatgtttggttaatttttttgtattattagtagagatgaggttttattgaggttttattgtgttagttgggatggtttgggttttttgattttgtgatttgtttaatttggttttttaaattgttgggattataggtatgagatattgtgtttggttgttgtttgattttttttagtagtgttttgtagttttttttgta

SEQ ID NO: 14977 - DNA, 201 bp, Artificial Sequence
  Description of Artificial Sequence: Synthetic polynucleotide
tttttgagtagttgggattataggtgtttgttattttgtttggttaattttttgtatttttagtagagatggggttttattgtgttagttaggatggttttgattttttgattttgtgatttgttagttttggttttttaaagtgttgggattataggtgtgagttattgtgtttggtttaatttaatttttaataatggt

SEQ ID NO: 14978 - DNA, 201 bp, Artificial Sequence
  Description of Artificial Sequence: Synthetic polynucleotide
aaaagttatagggggtgtgaggatagatggtgtgtttttttttatatatatggagatgtaggttggagtaatggtatatggattatgtatatgtggtggatgtattaatgtttatgtagaagagaataaaagttgtttttaattgggtataaattttttgtatttaaatattttgatatttataaataaaattagaataga

SEQ ID NO: 14979 - DNA, 201 bp, Artificial Sequence
  Description of Artificial Sequence: Synthetic polynucleotide
tgatttgttttttttggttttttaaagtgttgggattataggtgtgagttattgtgtttggtttaggttattttttttttttttttttttttttttgaggtggagttttgttttgttgtttaggttggagtgtagtggtgtgattttggtttattgtaagttttgttttttgggtttatatgatttttttgttttagtttt

SEQ ID NO: 14980 - DNA, 201 bp, Artificial Sequence
  Description of Artificial Sequence: Synthetic polynucleotide
ggattataggtgtgagttattgtgtttggtttaaattatggattttttttttttagtggagttttgtttttgtttaggttggaataggatggtatgaatttggtttattgtaatttttattttttgggtttaagtgatttttttgttttagttttttgagtagttgggattataggtatgtgttattatgtttggttagta

SEQ ID NO: 14981 - DNA, 201 bp, Artificial Sequence
  Description of Artificial Sequence: Synthetic polynucleotide
aattttttttttattttttttgtttttttattttataaaattgttattgttattatggtttatttttaatgagttgttgggtatattttttagatggggttgtggttgggtagaggggttttttattttttagtaggggtggttgggtagaagtgttttttattttttggatggggtggttggttgggtggggggttgatt

SEQ ID NO: 14982 - DNA, 201 bp, Artificial Sequence
  Description of Artificial Sequence: Synthetic polynucleotide
gggggttttttaagtttagttttgggtttgggttggggtatagggtagagtgggtttttttagtttttgttatgaggttaaggtagtgtattgtttgtagtgtatatttagaaattaaagtttaggagttggttattattttggtttatagttgatggaagagtaggtgtttttgagaatttatagtgttttttggttagt

SEQ ID NO: 14983 - DNA, 201 bp, Artificial Sequence
  Description of Artificial Sequence: Synthetic polynucleotide
tgggtagtagagtgagattttgttttaaaaaaaaaaaaaaaaagggggggttgggtgtggtggtttatgtttgtaattttagtattttgggagattgaggtgggtagattatgaggttaggagattgggattattttagttaaaatggtgaaattttgtttttattaaaaatataaaaaattagttgggtgtagtggtggg

SEQ ID NO: 14984 - DNA, 201 bp, Artificial Sequence
  Description of Artificial Sequence: Synthetic polynucleotide
gtgggagttatagggttttaggggaggagtgttttaggttgtggtaatagtaggtgtaaaggttttgaggtaggatggggtagggaggtttagagtttattgtgtagagatttgggaggttggtaggtatggtgaggattttgatttaaatttaggaaaggggaattatattggggtatgattttttgtattttttgagat

SEQ ID NO: 14985 - DNA, 201 bp, Artificial Sequence
  Description of Artificial Sequence: Synthetic polynucleotide
gggatttttttatgttggttaggttggttttgaatttttgattttaagtgatttatttgttttggttttttaaagtgatgggattataggtatgagttattgtgtttggttaagggtttttttagatgtaattaagttaagatgaggttatattgagttaggtgggttttaaatttaatggttagtgtttttataagtata

SEQ ID NO: 14986 - DNA, 211 bp, Artificial Sequence
  Description of Artificial Sequence: Synthetic polynucleotide
gttttagggttggaggagtaggagatttgggtagtggggtgggtgagtgttgggaggaggtaagaggttgtgggggaggaagatgttttttttggttttgtggggtaggttgtgtagggtaggttgtgtggggtaggtggggggtgttaaggaagtttgggtgtggttatattgtagagaaagttatgggaggtatgttttgagagttggg

SEQ ID NO: 14987 - DNA, 201 bp, Artificial Sequence
  Description of Artificial Sequence: Synthetic polynucleotide
gtagttaaagttatttttttggttgaaagatattttttttggggggaggagttaagatggttgagtaggaatagttttggtttatagtttttagtgtgagtgataaagaagatgggtgatttttgtatttgtatttgaggtatttggtttattttattagggagtgttagatagtgggtgtaggttagtgggtgtgtgtat

SEQ ID NO: 14988 - DNA, 201 bp, Artificial Sequence
  Description of Artificial Sequence: Synthetic polynucleotide
gtttaggatttgtagtttattatgtttgagttttttatttattttatgggtttttgtgttgtttaagttttttggatgagtgttattttttgttttatggtgtttagttttattgattatttaagggttgaggaatgtgagtatatggtgtaggattggtaggtagttttatttgtagttttggtgtgggatttattaggt

SEQ ID NO: 14989 - DNA, 201 bp, Artificial Sequence
  Description of Artificial Sequence: Synthetic polynucleotide
tggtaatattgtgaagatgtaggttttttatgggaaagattgttgtttggaagtttttatataataggtttttattgagattttaaggttgatagtatggtgggagtttttgggatttttgggtttggtatagtgttattgtagtaggtaggtattgggtggttagaagttgattatttttttaaatggtttgtatatatt

SEQ ID NO: 14990 - DNA, 201 bp, Artificial Sequence
  Description of Artificial Sequence: Synthetic polynucleotide
tttttatgggttgatttggtgattttttatggagaatgtgtaggagttggatattggtattgttaggtggaaaagttttttgttagggtgaaaagttagatggtgtttgttttttgtttttggagtgtttttggtttaatgtagtagttttgtagataaatgttatagaaggtagagtgttttatagatatgaaggagtgg

SEQ ID NO: 14991 - DNA, 201 bp, Artificial Sequence
  Description of Artificial Sequence: Synthetic polynucleotide
gatttttggatttgttgggttgtttttgtatttggttttttttttttaagtttgtggttgggtgtggtttttttaattttagtgttgatttttgtgtttgtgtgttttttttttattttttttatttgtggggttaggggttatatggtattgttgtttgggtttttgagtagggagagttgagtgttgattttgttagaa

SEQ ID NO: 14992 - DNA, 201 bp, Artificial Sequence
  Description of Artificial Sequence: Synthetic polynucleotide
ggatattttataaaatttttgatgagttttttttaaaattattaggttggttgggtgtggtggtttatgtttgtaattttagtattttgggaggttgaggtgggtagattataaggttaggagattgagattattttggttaatatggtgaaattttgtttttattaaataatataaaaaattagttgggtgtggtagtgg

SEQ ID NO: 14993 - DNA, 201 bp, Artificial Sequence
  Description of Artificial Sequence: Synthetic polynucleotide
tttttttttatttttttaggggtttgattttttttttaattgtatttttatagaatggttggttagataggaagttttggttggtgaagtttagtttttgtgggtataggttggtgaattttagagatttgggatttgggtaggttttgtatttgattttttatatggttttgatggagtagtagtagatgtttatttggt

SEQ ID NO: 14994 - DNA, 201 bp, Artificial Sequence
  Description of Artificial Sequence: Synthetic polynucleotide
aaattagttaggtttggtggtaggtatttgtaattttagttattttaggggttgaggtaggagaattgtttgaatttgggaggtggaggttgtagtgagttgagattgtgtttttgtattttagtttgggggataagagtgagattttgttttaaaaaaaaaaaaaaaaaaaaaaaaaggttgggtggtttatatttgtaa

SEQ ID NO: 14995 - DNA, 201 bp, Artificial Sequence
  Description of Artificial Sequence: Synthetic polynucleotide
tattgttatgatttgtgagtgtgtgttttttattttgttagagttggtagtgtgtgttatttatttggtgtttggttattattgttttatgtggatggtgtggttggtttttatgtatgtgtttttggtggttgaggttgatgtggatgtgttgttgtttatttttatgtttttgtgtttttatttgttgggttgggtgat

SEQ ID NO: 14996 - DNA, 201 bp, Artificial Sequence
  Description of Artificial Sequence: Synthetic polynucleotide
tttgtggggtttgtttgtttttttagttgttgttttttgggtggtgtttgttggtgttgatttttataatttattttttttagatagagtttttttttgttgtttaggttggagggaagtggtatgattttagtttattgaaatttattttttttgggtttaagtgatttttatttttgtttttggagtagttgggattat

SEQ ID NO: 14997 - DNA, 201 bp, Artificial Sequence
  Description of Artificial Sequence: Synthetic polynucleotide
ttattttagttttttgagtagttgggattataggtttgtgttattatgtttagtttattttttattttattttatttttatttttattttttttttgagatggagttttgttttgttgtttaggttggagtgtagtggtgggattttggtttattgtaagttttgttttttgggtttatgttatttttttgttttagtttt

SEQ ID NO: 14998 - DNA, 201 bp, Artificial Sequence
  Description of Artificial Sequence: Synthetic polynucleotide
aaatggtgatttagaggttgtttttatttgatgggtttttttagttgaagatgtttagttaatgaattttaagtagatttatggttgggtgtgaagttaatggagtttttattttgtggagatgagtagtataaatttttgtttttaatgtttaatgatatgtaaaatatttaaatttgtaatgtagaattattaagttgt

SEQ ID NO: 14999 - DNA, 201 bp, Artificial Sequence
  Description of Artificial Sequence: Synthetic polynucleotide
ggtaggtggattattttagtttaggagtttgagattagtttgggtaatatggtaaaattttatttttataaaaaatataaaaattagttggttatggtgttgtgtatttgtagttttagttattagggagattgaggtgggagggttatttaagtttgggagaggtgggtgtggtggaggttgtagtgagttaagatgtat

SEQ ID NO: 15000 - DNA, 201 bp, Artificial Sequence
  Description of Artificial Sequence: Synthetic polynucleotide
tagattgatagattttttttttttttgagatggagttttgtattgttatttgggttggagtgtagtggtgtaattttggtttattgtaatttttttaatttgtgtttaagtaatttttttgttttagttttttgagtagttgggattatagggtgtgttattatgtttggttaattttttgtatttttagtagagatgggg

SEQ ID NO: 15001 - DNA, 201 bp, Artificial Sequence
  Description of Artificial Sequence: Synthetic polynucleotide
ttttgggtggtaaggattttatggtgttggtatatgtgttgtgtatgttggtattgggtttgggtattttattgtagtttatggttgtagataagggtattgggtgtggtttagtgggaggattttagtaaggagttggggaaatatgtatgtgtttatttagggttggagtttattgaaggtttatgtgggtagtatgtg

SEQ ID NO: 15002 - DNA, 201 bp, Artificial Sequence
  Description of Artificial Sequence: Synthetic polynucleotide
tggtttattgtaatttttattttttgggtttaagtgatttttttgttttagttttttgagtagttaggattataggtatgtattattatttttggttaattgttgaatttttagtagagatggggttttattatgtttgtaaggttggttttgaatttttgattttaggtgatgtttttatgttggttttttaaagtgtta

SEQ ID NO: 15003 - DNA, 201 bp, Artificial Sequence
  Description of Artificial Sequence: Synthetic polynucleotide
tggttttttaaagtgttgagattataggtgtgagttattgtgtttggtttattttaggtgatttattttttttagttttttaaagtgttgagattataggtgtgagttattatgttgggtttattttaggtgatttattttttttggttttttaaagtgttgagattataggtgtgagttattgtgtttggtttattttag

SEQ ID NO: 15004 - DNA, 201 bp, Artificial Sequence
  Description of Artificial Sequence: Synthetic polynucleotide
gatttgagaattgtttgtattagtttggttttttgtatagtgtttgtgttggtgtatattttagaggggagttgtgttattagatgaattaggattttggtggaggaagggggtgttggtagggtttttatggtatttgttgtttgtggttgaggggagtttggaagggtattagttttatttatttttggttgagatttt

SEQ ID NO: 15005 - DNA, 201 bp, Artificial Sequence
  Description of Artificial Sequence: Synthetic polynucleotide
tttggtatatttagagtatattggggttggggtagatggtggtatttgttttggttggaggagttgggagggttggggaagggatgtgtgattttttttttgataaatttggatgagatgttaagtataatatagaggttggtggtggggtttttttttgtttttggtggattaatttattgtgggattttgggtaatttt

SEQ ID NO: 15006 - DNA, 201 bp, Artificial Sequence
  Description of Artificial Sequence: Synthetic polynucleotide
ttaaaaaatatatatggttgggtgtggtggtttatgtttgtaattttagtattttgggaggttgaggtgggtggattatgaggttaggagattgagattatggtgaaattttgtttttattaaaaaaatataaaaaattagttgggtgtagtggtgggtgtttgtagttttagttgtttgggaggttgaggtaggagaatg

SEQ ID NO: 15007 - DNA, 201 bp, Artificial Sequence
  Description of Artificial Sequence: Synthetic polynucleotide
atggttatatggtagggtttttgttgtttttattgttgttagtttagttgtttgttattttttttagtggtgtttttgttattaatgggttttttataattgatttggtttatgggttgtagatgttgtggattattggtgtggggaagtatgagtttattgatttggggtattttagaggtaagttttgttgttatgtgt

SEQ ID NO: 15008 - DNA, 279 bp, Artificial Sequence
  Description of Artificial Sequence: Synthetic polynucleotide
gggtttgggtttgttaggtgtagaataaggagaaaggggtagaggggaagagttgggttgaattttagtgagggatttggttttttttggaggagaggattgtatttgtgttaggagtatggatttatttagggagtgtttgggtggagaagtagtttttgttttaggttttttgttgtggtatttaaagaggttgggtggtttagaggtttgtaagttatgtttttttttaggttttgtttttgtttggttattttttttgttgttagtttttttatt

SEQ ID NO: 15009 - DNA, 201 bp, Artificial Sequence
  Description of Artificial Sequence: Synthetic polynucleotide
ttggttgttatgaaattataaattatgtttatagaaattttagtttgagaaagaatttagatttttttttttttttttttttttttttgagattgagttttgttttgttgtttaggttggagtgtagtgatgttattttggtttattgtgagttttgttttttgggtttatgttattttttggttttagttttttgtgtag

SEQ ID NO: 15010 - DNA, 201 bp, Artificial Sequence
  Description of Artificial Sequence: Synthetic polynucleotide
ttgggggtggggtggggtggggtggggtggggtgggggggtggggttgaggtaggagaatggtgtgaatttgggaggtggagtttgtagttagttgagattgtgttattgtattttaatttgggtgatagtgattttattttaaaaaataataataataaaaaagaataaagattttataggtattttttttatagtagag

SEQ ID NO: 15011 - DNA, 201 bp, Artificial Sequence
  Description of Artificial Sequence: Synthetic polynucleotide
ggggttttattgtgttagttaggatggttttggttttttgatgttgtgatttttttatttaggttttttaaagtgttgggattataggtgtgagttattgtgtttggtttagttttttatttttaataagtttttaggtgatgtttatgttggtagttttttgagattattatattttaagttttagggtgttagaaaaac

SEQ ID NO: 15012 - DNA, 201 bp, Artificial Sequence
  Description of Artificial Sequence: Synthetic polynucleotide
tgttgttgttgtttttaagttggagttttgttttgttatttaggttgtagtgtagtggtatgattttggtttattataattttggttttttgggttttagtgatttttttgttttagttatttaagtagttgggtttataggtgtatgttattatgtttggttaatttttgtatttttaggagagataggtttttattatg

SEQ ID NO: 15013 - DNA, 201 bp, Artificial Sequence
  Description of Artificial Sequence: Synthetic polynucleotide
aattgagttgtggaatggggttttgtggagtaggttgagtgtgttggttgtggatgggttgtgggtgggattttttagtgtgttattattgaggtatttttgtttttttatgtgtttttgtttttttttttagaagtttaatatttttgagaggatttaaaatatagagtgattagtttttatgtgtattttttggataaa

SEQ ID NO: 15014 - DNA, 201 bp, Artificial Sequence
  Description of Artificial Sequence: Synthetic polynucleotide
aggggagatgaagaaggagggggtagtttgtttaggaggttaggggggtatttgtgtttggtttaggtttattgatgtagatattattgatatttatgtttgtgttgtgttttttgtggtgtttgtggttgttaatgttatttattgggtggtatatgttatgtgagtataggatttaggttatttttgtttgttttggtg

SEQ ID NO: 15015 - DNA, 201 bp, Artificial Sequence
  Description of Artificial Sequence: Synthetic polynucleotide
ttatatattttatgtgttttgtttattatgaggtttgtattttttgggtagtaggtgttgtgtgtttttgggtattttgtaggtggagttgttggtgtagtgtagtattttgtgtttttgatgttggttttggatttagttgttgttgtatttgttattgtttttgggggatatatgtatggagtttatttttaatagggg

SEQ ID NO: 15016 - DNA, 201 bp, Artificial Sequence
  Description of Artificial Sequence: Synthetic polynucleotide
tttattataaatataaaaaattagttgggtgtggtggtgggtatttgtagttttagttatttggaaggttgaggtaggaaaatgatgtgaatttgggaggtggagtttgtagtgagttgagattgtgttgttgtatttaagtttgggtgatagagtgagattttgggttaaaaaaaataaaagaatatagggtatggtatt

SEQ ID NO: 15017 - DNA, 201 bp, Artificial Sequence
  Description of Artificial Sequence: Synthetic polynucleotide
tagagtagttgggattataggtgtttattgttatgtttggtttatttttttttgtatttttagtagagatggggttttattgtgttagttaggatggttttgattttttgatgtgatttatttgttttggttttttaaagtgttgggattataggtgtgagttattgtgtttggtttatttatgtgttttttgggaagggg

SEQ ID NO: 15018 - DNA, 201 bp, Artificial Sequence
  Description of Artificial Sequence: Synthetic polynucleotide
aggtgtttgttattatgtttggttaattttttgtatttttagtagagatggggttttattatgttagttaggatggttttgattttttgattttgtgatttgtttattttgtttttttaaagtgttgggattataggtgtgagttattgtgtttggttgttttttggtatattttttatttttagtatgtggtttttatat

SEQ ID NO: 15019 - DNA, 203 bp, Artificial Sequence
  Description of Artificial Sequence: Synthetic polynucleotide
gttggttatggaaggttatagttttgtagatggtgttggtggagtttggggtagggtattttgagtttgggaaggtttggggtgaaggtttggaggttggtgtgtaggaggttaaagtagtagggaggtttggggagagttaggtggggttgtgttttttatgttgtaggttgtgtttatagatggtgaaagatgttgtggaa

SEQ ID NO: 15020 - DNA, 201 bp, Artificial Sequence
  Description of Artificial Sequence: Synthetic polynucleotide
ttttaagtagttgggattataggtgtttattattatgtttggttaatgtttttgtttttttagtagagatggggttttattgtgttagttaggatggttttgattttttgattttgtgatttttttgttttggttttttaaagtgttgggattatagtaattatttgatggtgtgagttattgtgtttggttatgtatgat

SEQ ID NO: 15021 - DNA, 201 bp, Artificial Sequence
  Description of Artificial Sequence: Synthetic polynucleotide
tttatttttgtgaaaatttttgtgtttgaaaattattgtaaaatatttggaattattattattatttatttttattttttgagatggagttttgttttgttgtttaggttggagtgtagtggtgtgattttggtttattgtaagttttgttttttgggtttatgttatttttttgttttagttttttgagtagttgggatt

SEQ ID NO: 15022 - DNA, 201 bp, Artificial Sequence
  Description of Artificial Sequence: Synthetic polynucleotide
ttggtgagagataaggtatttagggaaagaagaaaaaagtttaggaagggattttagtttgttagatttggggtagaagttttttttggatgagtttttatggagaaatttaaatattaggggttttggaaggttggaagtttttaagttgtttaggaaaagattaaagagatataaattataaaagttttgggattttta

SEQ ID NO: 15023 - DNA, 201 bp, Artificial Sequence
  Description of Artificial Sequence: Synthetic polynucleotide
gttattgattttgagtttttgtttttttatttataaaattgagattagggttgggtatggtggtttatttttgtaattttaatattttgggaggttgaggtgggtggattatgaggtgaggagtttgagattagtttgattaatatggtgaaattttgtttttattaaaaatataaaaattagttgggtgtggtggtgtgt

SEQ ID NO: 15024 - DNA, 201 bp, Artificial Sequence
  Description of Artificial Sequence: Synthetic polynucleotide
gtatgtttattgtagaattatttataatagtaaagatatggatagattggattaagaaaatgtggtgtatatatatatatgttatggaatattatgtagttgtaaaaagaataaaatttggttttttgtagtaatatggatgtagttggaggttattatttggagtgaattaatataggaatagaaaattaaatattgttt

SEQ ID NO: 15025 - DNA, 201 bp, Artificial Sequence
  Description of Artificial Sequence: Synthetic polynucleotide
ttttagttttgtgattggttttttgttttgtgttgatatttagtattttttttggtttttgttttgaggggaaaataaaataggggtttttaggttttattgttggtttattttattgtagtaaattgattgagggttttttgttgtgtttttgtggtttgttgttttatttagtggttttgatatttggtatttatttaa

SEQ ID NO: 15026 - DNA, 201 bp, Artificial Sequence
  Description of Artificial Sequence: Synthetic polynucleotide
gtgggtggattatgaggttagtagattgagattattttggttaatatggtgaaatttagtttttattaaaaatataaaaaattagttgggtgtggtggtatgtgattgtagttttatttattggggaggttgaggtaggagaattgtttgaatttgggaggtggaagttgtagtgagttgagattgtgttattgtattttc

SEQ ID NO: 15027 - DNA, 201 bp, Artificial Sequence
  Description of Artificial Sequence: Synthetic polynucleotide
ttttattttttagttagttttttgtgtagtgtttagggttttggtagttaggatagagtgagtaaaagaagatggatagtggatagggtgtagtggtttatgtttgtaattttagtgttttgggagagtgaggtgggtagattataaggttaagagattaagattattttggttaatatggtgaaattttgtttttattaa

SEQ ID NO: 15028 - DNA, 201 bp, Artificial Sequence
  Description of Artificial Sequence: Synthetic polynucleotide
aaggtaggtggattatggggttaggagtttgagattagtttggttaatttggtgaaaatttgtttttattaaagatataaaaattagttgagtgttgtggtgtatgtttgtaattttagttattggggaggttgaggtaagagaattatttgtaattgggaggtggaggatgtagttagtgagatggtgttattgtatttt

SEQ ID NO: 15029 - DNA, 201 bp, Artificial Sequence
  Description of Artificial Sequence: Synthetic polynucleotide
atttagggggttgaggtaggagaattgtttgaatttgggaggtggagtttgtagtgagttgagattgagttattgtatattttagtttgggtaataagagtgagatttagttttagaaaaaataaataaataataaaataaaaagtaggttgggtgtgatggtttatatttataatattagtattttgggaggttgaggtg

SEQ ID NO: 15030 - DNA, 3238 bp, Artificial Sequence
  Description of Artificial Sequence: Synthetic polynucleotide
tagaatgttaggtgtgaaaggtgatgttgaggtagtatgagggaaaaagtagtaggtagtgattgttatatggatgatagtgtttttttggtagtttttgtgttagatttggggttgttgtggagtttttgatttgaatttagggtgtgtgttgtgtttatggggggatattttaaagtggtaagaatgttttttgggaagggaataggatgttaggtttgaaaggggattttgaagtagtttaggaaaaaattttttatggattatggtgtttttttggtagtttttttgttaggtttgagggggttgttgtgttttaggtttgtatttagggttttatggggggtattttaaagtggtaagtaggtttttaggggaaggggatagtatgttaggtttggagggggatgttgaggtagttttgggaataaagaggggatgttggggttttgttatggataatattgtttttttgatagtatttgtggtgggtttgggagtgttatggagtttttggtttgtatttaaggtgtgtgttttgtttttggggggtattataaagtggtaagaaggttattgggggaagggtatgggatgttagggttgaaagggatagttgaggtagtttggggaaaaatgtggtaggttggggttgttttatggatgatagtgtttttttagtagtttttgtgttaggtttggggtggttgtggagtttttggtttgtattgagggtgtgggttgtatttatgggggtattttaaagtggtaagaaggttgttgggtgaatgttatagaaggttaggttttaatggggatgttgaggtagtatagagagaaaagtggttagttgggttttttttatggatgatagtgtttttttggtagtttttgtgttgggtttggggggattgtggagtttttattttgtatttagggtgtgtgttttgtttatgggaggtattttaaagtggtaagtaggtttttgggggaaggggatagtattttagatttgaagggggattttgaggtagtttgtggaaaaaaatggtgatgttgagttttttttataaatgatagtgtttttttggtagtttttttgttgggttagggtggttttggagtttgtggtttgtatttagggtgtgtgttttgtttaagggggtattttaaagtggtaagtagatttttgggggaagggagagtatgttaggtttgaaggggaggttgaggtggttttggggtaaaagtggtgaagttggggtttttttatggatgatattgtttttttggtagtttttgtagtgggtttagaggtgttgtggagtttttggtttgtttttaggttgtgtgttttgtttatgagtggtattataaagtagtaagaaggtttttaggggaagggtataggattttagggttgaaaggtagagttgaggtagattggtgttattttaaggataatagtgttttgtttggtagtttttgtattgggtttggggtggttgtggagtttttggtttgtatttggggtgtgtgttgtgtttatgatgggtattgtaatgtggtaagaagtttttgagtggaagggaataggatgttgagtttgaaaggggatgttgaggtagtttggggaaaaaatttttattgagaatagtgtttttttggtagtttttgagtgggatttaggtggatggtggagtttttggtttggatttagggtgtttgttttgtttatggggtgtatgtgaaagtggtaatagggtttttgggggaaggggataatatgttaggtttgaagagggatgttgggttagttagaggaaaatagtggttaggttgtggttgttttatagattatagtgtttttttggtagtttttgagtttggtttaggtgggggggtttggagtttttgttttgtaatagagtgtgtgttttgtttaagtgtgtatgtgaaagttgtaagaagggttttgggggaagggaataggatgttaggtttgaaaggggattttgaggtagtttagggaaaaattttttatggaggatagtgattttttgatattttttgtgtttggttttgggggttttggagtttttggtttatatttagggtgtgtgttttgtttatgggtggtattttaaagtagtaagaaagttttggggggggaagaataggatgttagatttgaaaggggatgttgaggtagtttaggaaaaaaaggggtgaggttggggtttttttatggatgatagtgttttttttatagtttttatgttagttttgggagggttgtggagtttttgttttgtatataatgtgtgtgttttgtttatggggggtattttaaagtggtaagaagttttttgtgggaaggtaataggatgttaggtttgaatggggatgtttaggtagtttggagaaaaaagtagtgaggttggggtgattttatgaatgatagtgttttattggtagtttttttgttgggtatgtgggggttgttgattttttggtttgtatttagggtgagtgttttgtttatggtgggtattataaagtagtaagaaggtttttgggggaaagggatagtatgttagttttgaagggggaagttgaggtagttttggggaaaaaaagtggggatgttggggtttttttatggatgatattgtttttttagtagtttttgtagtgggtttgggagtgttttggagtttttgttttgtattttgggtgtgtgttttatttatggggagtattataaagtggtaagaaggttattgggggaagggtataggatgttagggttgaaggggatagtggagatagtttaaggaaaaaagtggtgggatggtgttgttttaaggatggttatttttgtgttgggttagggatggttgtggagtttttggtttgtatttaggttgtgtgttttgtttatagggggtattttaaagtagtatgaaggtttttaggggaagggaagaggatgttaggtttggaaggtgatgttgaggtagtagggggtaaaaagtggtgggttgggtttttttatggatgatagtgtttttttggaagttgttgtgtagggtttggtgtgtttgtggagtttttggtttgtatttagaattgtgtggtgtttatgatgggtattttaaagtggtaagatattttttgttggaagggaataggatgttaggtttgaaaggagaagttgagttagtttggggaaaaa

SEQ ID NO: 15031 - DNA, 201 bp, Artificial Sequence
  Description of Artificial Sequence: Synthetic polynucleotide
ttaaggttattattttaaagtgttttagaaaataatatatagaaggttgggtgtggtggtttatgtttgtaattttagtattttgggaggttgaggggggtggattatgaggttaggagattgagattattttggttaatatggtgaaattttgtttttattaaaaatatatatatataaaattagttgggtgaggtggta

SEQ ID NO: 15032 - DNA, 201 bp, Artificial Sequence
  Description of Artificial Sequence: Synthetic polynucleotide
ttattatttatttattattttgtttgtaatttgggttattatttattagtaatttgatgattaatatgttttattttagtaggtgtgtaaggtgtgggggtggatataaagattgtggtttttggagaggatggttagggggttgtttttgtaagtgttttttaaaataattggttattgtttttgagtgtttgggtgttg

SEQ ID NO: 15033 - DNA, 201 bp, Artificial Sequence
  Description of Artificial Sequence: Synthetic polynucleotide
atggtgattagaaatgtattaaattttgaatgtataaaagagagagttttaatatgaaatagtaattttttgagaatgaagattttgtagtgttggtgtttgttgggttgtgtaggttttggttgttttatgtttgtgtttgtttttattgtgatttttttgtttttggtatgtttagggttaatttttgggtttattgta

SEQ ID NO: 15034 - DNA, 201 bp, Artificial Sequence
  Description of Artificial Sequence: Synthetic polynucleotide
tttggggattattttgtttttttgttttgattttttttttttttttttttttttttttgagatggagttttgttttgttgtttaggttggagtgtagtggtgtgattttggtttattgtaagttttattttttgggtttatattatttttttgttttagttttttgagtagttgggattataagtatttgttattatgttc

SEQ ID NO: 15035 - DNA, 201 bp, Artificial Sequence
  Description of Artificial Sequence: Synthetic polynucleotide
tttttgggatggggggatttttaggtatttttgggttttgagttgggttgttagggttgtttgttttttgttgttttttttgggttgagttttgtttttgtgttttgtagtggagtagttgtttttaaaggtgtatgtgattagggtgtggttgggatagtgggtatttttttgggttttagtgttgtgtgtgttttggtc

SEQ ID NO: 15036 - DNA, 201 bp, Artificial Sequence
  Description of Artificial Sequence: Synthetic polynucleotide
tggtgtttggtatgaaattttttttttttttttgagatagagttttgtttttgtgtttaatttggagtgaagtggtatgattttggtttatggtaatttttgttttgtaggattaagttattattttgatttagttttttgagtagttgggattataggtatttattattatggttggttaatttttgttttttgtttttt

SEQ ID NO: 15037 - DNA, 201 bp, Artificial Sequence
  Description of Artificial Sequence: Synthetic polynucleotide
aagtagttttttaaaattttaaaaagtaagtatagttttaggaaggagggaggttagtgaaattaaatttttgttgataagtttaaagtaattggtaagatgttgggaaattagatattgaaatatttgtttttaatttttaatttgttattatttgaaataaagttattagggatagttgggtgtggtggtttatgtttg

SEQ ID NO: 15038 - DNA, 201 bp, Artificial Sequence
  Description of Artificial Sequence: Synthetic polynucleotide
atttattgaagaagttgaagtgtgaagtgtgaaattgaagaattttgaaatgtattgagtagtgaaaagattatgtatataaaaataggttggttgggtgtggaggtaggtagattatttgaggttaggaggtgtgattttggtttattgtaagttttattttttgtgtttatgttatttttttgttttagtttttggagt

SEQ ID NO: 15039 - DNA, 201 bp, Artificial Sequence
  Description of Artificial Sequence: Synthetic polynucleotide
attttgggaggttaaggtaggtggttgggaggtgtaggttgtagtgagttgagattatgttattgtattttagtttgggtattattgagtattgagtgaatgagattttgtttgtaattttggtattttgggaggttgaggttggtggattatttgtggttaggggttggagattggtttggttaatatagtgaaattttg

SEQ ID NO: 15040 - DNA, 201 bp, Artificial Sequence
  Description of Artificial Sequence: Synthetic polynucleotide
gtggtgtaattttggtttattgtaagttttgttttttaggtttatgttatttttttgttttagttttttgagtagttggtattataggtgttgattattatgtttggttaattttttgtattttttgatagagatggggttttattgtgttatttaggatggttttgatattttgattttgtgatttgtttgttttggttt

SEQ ID NO: 15041 - DNA, 201 bp, Artificial Sequence
  Description of Artificial Sequence: Synthetic polynucleotide
ggtgggygggttaygaggttaggatatygagattattttggttaatayggtgaaatttygtttttattaaaaatatagaaaattagtygggtatgttggygggtatttgtaagttttagttattygggaggttgaggtaggagaatggygtgatttygggaggyggagtttgtagtgagtygagattaygttattgtattt

SEQ ID NO: 15042 - DNA, 208 bp, Artificial Sequence
  Description of Artificial Sequence: Synthetic polynucleotide
tttatttatttatttttgagatagagtttygttttgtygtttaggttggagtgtagtggtgtgatttyggtttattgtaagtttygtttttygggtttaygttattyggttttagtttttygagtagttgggattataggygttygttattaygttyggttaattttttatatttttagtagagatagggttttattatgttagttag

SEQ ID NO: 15043 - DNA, 201 bp, Artificial Sequence
  Description of Artificial Sequence: Synthetic polynucleotide
ttttttttttttttttttttttttttgagayggagtttggttttgttgtttaggttggygtgtagtggtttattgtatttttygtttttygggtttaagygatttttttattttagttttttaagtagttggggttaaaggtttgtgttattatgttyggttaattttttgtattttagtagagayggggttttatygtgt

SEQ ID NO: 15044 - DNA, 201 bp, Artificial Sequence
  Description of Artificial Sequence: Synthetic polynucleotide
tygtggtgtaattttagtttattgtaatttttgtyggtagggtttaagtaatttttttgttttagtttttygagtagttgggattataggtaygtattaygatgttyggttaatttttgtatttttagtagagatggggttttattatgttgattaggttggttttgaatttttgattttaggtgattygtttatttyggt

SEQ ID NO: 15045 - DNA, 201 bp, Artificial Sequence
  Description of Artificial Sequence: Synthetic polynucleotide
gtgggttttaaatattttataagttagagtaattagaatagtatggtattggtataaagataggtatatagtttgttyggtttygtttygttttgtygtygygtttgttagttatgagttttatgtagttaaataaaggtttttttgtggatttttggttgaggttaagaatyggtttttgtttaaatatgatttttagaa

SEQ ID NO: 15046 - DNA, 201 bp, Artificial Sequence
  Description of Artificial Sequence: Synthetic polynucleotide
tattgatttggaagaayggaatgatagttagtgaggtatatttagtaatygagtayggttagtgtyggttttyggttttygagatattgatttaygtagygttaggattyggggattttttaggtgtaaattagaggttaaatagtttgtttggttaatgggttagaatttgtggttgaatagaggttttgttgtggtttt

SEQ ID NO: 15047 - DNA, 201 bp, Artificial Sequence
  Description of Artificial Sequence: Synthetic polynucleotide
ttatttttgggggatgagaggagggatggtgagaggatatttttaaagaatatttggggtyggggaagaattttttatgatttygttttataatttggtygtttattttgtattttgttgtaygttgttyggtttttggttatgttatgtgaatttttggagttattttttttttttttttatttggatggagagggtttt

SEQ ID NO: 15048 - DNA, 201 bp, Artificial Sequence
  Description of Artificial Sequence: Synthetic polynucleotide
tttaatagatatgaaaattgaaggtygggygtagtggtttaagtttgtaattttagtattttgggaggtygaggygggyggattaygaggttaggagatygagattattttggttaatatagtgaaatttygtttttattaaaaatattaaaaattagtygggygtggtggygggygtttgtagttttagttatttgggag

SEQ ID NO: 15049 - DNA, 201 bp, Artificial Sequence
  Description of Artificial Sequence: Synthetic polynucleotide
ttgaatagttgggattataggygtttgttatygygttyggtttattttttgtgtgtttttagtagagayggggttttatygtgttagttaggatggtttygattttttgatttygtgattygttygtttyggttttttaaagtgttgggattataggtttgagttatygygttyggttaaaataattaatttttgtgttaa

SEQ ID NO: 15050 - DNA, 201 bp, Artificial Sequence
  Description of Artificial Sequence: Synthetic polynucleotide
ayggatttttgyggtgagtgttatagtttttaaaggtggygtgttyggagtttgttttttttgatgttyggatgtgttyggagttttttttggtgggttygtggttttgtyggtttaggagtgaatttgtagatttttgyggtgagtgttatagtttataaaggtagtgtggatttatagagtgaatagtagtaagattta

SEQ ID NO: 15051 - DNA, 201 bp, Artificial Sequence
  Description of Artificial Sequence: Synthetic polynucleotide
tattaaaaataaagaaggaggtygggygyggtggtttaygtttgtaattttagtattttgggaggtygaggtgggyggyggattaygaggttaggagatygagattayggtgaaatttygtttttattaaaaatataaaaaattagtygggygyggtggygggygtttgtagttttagttattgggaaggttgaggtagga

SEQ ID NO: 15052 - DNA, 201 bp, Artificial Sequence
  Description of Artificial Sequence: Synthetic polynucleotide
gttaagatagygttattgtattttagtttgggaatagagygagatttygttttaaaaaaaaattattgatatatataaatatttgtgaaattggttgggygyggtggtttaygtttgtaattttagtattttggggggtygaggygggygtattataaggttaggagatygagattattttggttaatayggtgaaatttt

SEQ ID NO: 15053 - DNA, 235 bp, Artificial Sequence
  Description of Artificial Sequence: Synthetic polynucleotide
gtttatagtttttagagagagygaygtagaagatgggtgatttttgtatttttatttgaggtatygggtttattttattagggagtgttagatagtgggygtaggttagtgggtgygygtattttgygtgagtygaagtagggygaggtattgttttatttyggaagtataaggggttagggagtttttttttttagttaaagaaaggggtgatagayggtatttggaaaattgg

SEQ ID NO: 15054 - DNA, 201 bp, Artificial Sequence
  Description of Artificial Sequence: Synthetic polynucleotide
tttygagtagttggygttataggygtttattattaygttyggttaattttttgtatttttagtagagatagggttttattatgttagttaggatggtttygattttttgatttygtgattygttygttttggttttttaaagtgttgggattataggtatgagttatygyggtyggttttaattatgtatttttatttatt

SEQ ID NO: 15055 - DNA, 201 bp, Artificial Sequence
  Description of Artificial Sequence: Synthetic polynucleotide
ttgattatttaggtgygtttgttatttttttttttgattyggaaagggaattttttgtttttttgygttttttaagtgaggtaatgtttygttttgtttyggtttgygtatggtgtaygtatttattgattygygtttattgtttggtattttttagtgagatgaattyggtattttagatggaaatgtagaaattatttg

SEQ ID NO: 15056 - DNA, 201 bp, Artificial Sequence
  Description of Artificial Sequence: Synthetic polynucleotide
tgggtygttgggtgttygggttgtttttttattgtttaggataaattttatttygttttatyggtygatggtttgtyggggagttygygggygagtyggygtttgtaggtgtgtttttttgttgatatgtttttygtgattagtygtttttgtttttttttattgatgygtttttttygttttttagtagtttttgttttt

SEQ ID NO: 15057 - DNA, 201 bp, Artificial Sequence
  Description of Artificial Sequence: Synthetic polynucleotide
tatttggttyggagggttttatgtttatygagttttgttgattgttagtatagtagtttgagattaaattgtaaggtagtagygaggttgggggaggggygttygttattgtttaggttygtttaggtaaataaagtagtygggaagttygaattgggtggagtttattatagtttaaggaggtttgtttgtttttgtagg

SEQ ID NO: 15058 - DNA, 201 bp, Artificial Sequence
  Description of Artificial Sequence: Synthetic polynucleotide
tygttttgtagtttgattttagattgttgtgttagtaattagygagattttgtgggygtaggattttttgagttaggtgtyggatataatttttaggtgygtygttttttaagttygtyggaaaagygtagtattttggtgggagtgattygattttttaggtgttttttgttatttttttttttgattaggaaagggaat

SEQ ID NO: 15059 - DNA, 201 bp, Artificial Sequence
  Description of Artificial Sequence: Synthetic polynucleotide
agygaygtagaagaygggtgatttttgtatttttatttgaggtatygggtttattttattaagggagtgttagatagtgggygtaggttagtgggtgygygtatygtgygygagtygaagtagggygaggtattgttttatttgggaagtataaggggttagggagtttttttttygagttaaagaaaggggtgayggayg

SEQ ID NO: 15060 - DNA, 201 bp, Artificial Sequence
  Description of Artificial Sequence: Synthetic polynucleotide
tattaggatattttggttgtagagaggagttatttatygygagttttttttgagttgttttattatttagtaaagtttttttttattttgtttatttttygtttgtttaygtaygttattgttttygggygttgaatttgttaaatggtggaggtgaaagagttttaatataaatagagttgaaataygttttttgtttgt

SEQ ID NO: 15061 - DNA, 201 bp, Artificial Sequence
  Description of Artificial Sequence: Synthetic polynucleotide
gttggagtgtaatggtatgattttggtttattgtaatatttgtttttygggatttagtaatttttttgttttagtttttygagtagttgagattataggygattattattaygttyggttgatatttgtatttttagtagagayggggttttattatgttggttaggttggtttygaatttttgattttaggtgatttgtt

SEQ ID NO: 15062 - DNA, 201 bp, Artificial Sequence
  Description of Artificial Sequence: Synthetic polynucleotide
tattgttggtattagtatttggaagaggggaatatygtggtttttgaaaatttggagtygttagtaattgaggagttttaaggagtgagaygggggtgtygttttattatttttttatttttgtagtyggtagttttgttagyggtgggggtygggttgaggggtggtggtatattaggggggtggtggtatatattatag

SEQ ID NO: 15063 - DNA, 201 bp, Artificial Sequence
  Description of Artificial Sequence: Synthetic polynucleotide
gtttttyggtattattagtatttgggttttttggagyggaagtggttggtyggggatatgtagtttatagaggtttagatgaaaatttggttttaaaatygttagatgaaataygaayggtaaatgtaggatttatagttgaatagtttttttttggggtttttttaygygttygggttttttatttatygttttttggtt

SEQ ID NO: 15064 - DNA, 207 bp, Artificial Sequence
  Description of Artificial Sequence: Synthetic polynucleotide
attagagtagaggggtttttttattttttgtttagttttttgatttggttttttattttttaggaaatatatttyggttygaggtttatttgttgtygtygtygtyggaggagttggttttgaaygagttggtgaygttgaygtgtttggtaygtggttttagttttaaggatgtgttggttygttggttgtaggggttataggagt

SEQ ID NO: 15065 - DNA, 201 bp, Artificial Sequence
  Description of Artificial Sequence: Synthetic polynucleotide
atattaggggaagaagatataagygttggttatttataggagtattttagtagaaggataygttgataggtattyggaagttagtaggtygtggattagygggaggaggyggaggttggtttgggtagttaggggagagtyggggttgtygagtattttaattttaggggaaaattattttttttttggttgttttatggg

SEQ ID NO: 15066 - DNA, 201 bp, Artificial Sequence
  Description of Artificial Sequence: Synthetic polynucleotide
tygattttttaggtgygttygttatttttttttttgattyggaaagggaattttttgattttttgygttttttaagtgaggtagtgtttygttttgtttygygtayggtgtaygtatttattgatttgygtttattgtttggtattttttagtgagatgaaatyggtattttagatggaaatgtagaaattattygttttt

SEQ ID NO: 15067 - DNA, 201 bp, Artificial Sequence
  Description of Artificial Sequence: Synthetic polynucleotide
ttaygttttaggtatatygatattttygtattggttttttttaggaggttaygttttaggtataygggtatttttatattgattttttttagtaggttaygttttaggtataygggtatttttatattgatttttttygggaggttaygttttaggtataygggtatttttatattggttttttttaggaggttaygtttt

SEQ ID NO: 15068 - DNA, 201 bp, Artificial Sequence
  Description of Artificial Sequence: Synthetic polynucleotide
gtttttttgttyggtygtttagtttgggaagtgaggagygtttttttttggtygttatttygtttaggaagtgaggagygtttttgttyggttatttatygtttgggatgtggggagtatttttgttaggtygygattttatttgggaattgaggagtgtttttgtttygttattattttatttgggaggtgaggagygtt

SEQ ID NO: 15069 - DNA, 201 bp, Artificial Sequence
  Description of Artificial Sequence: Synthetic polynucleotide
gagggagaygyggggygggaattggggttgttygyggtaggttagagtaagttttgggtggatatggttttggygggttttatatttygagtagttggtygttttattagtttygggtagtgaggggtttattattygggatagtagttgtggagggtgygtygagttttttagtagtgttagttygtyggygttgtgttc

SEQ ID NO: 15070 - DNA, 201 bp, Artificial Sequence
  Description of Artificial Sequence: Synthetic polynucleotide
tttgattaaaaataaataaatatggtygggtgyggtggtttaggtttgtaattttagtatttygggaggtygaggyggtggattataaygttaggagatygagattattttggttaatayggtgaaattttatttttattgaaaatataaaaaattagtygggygtggtggtgggtatttgtagttttagttatttaggag

SEQ ID NO: 15071 - DNA, 201 bp, Artificial Sequence
  Description of Artificial Sequence: Synthetic polynucleotide
yggttagggggtatttttagaygtatagaagtttyggaggttatggtaagtttgtaatygggattygtttttaggtttataygtgtagttttttagttgygtaatttttttaaatggagtagttttggygtgggtggggttygggtyggtagtgggggyggggtyggtagtgggggyggggttagttgggggaggaggggg

SEQ ID NO: 15072 - DNA, 201 bp, Artificial Sequence
  Description of Artificial Sequence: Synthetic polynucleotide
tatggygaaattttatttttattaaaaatataaaaattagttgggygtggtagtgtaygtttgtaattttagttatttgggaggttgaggtaggattatygtttgaattyggaaggtggaggttgtagtgaattaagagagyggttttgtattatagtttgaaygatagagtaagattttattttaaaataattaattaat

SEQ ID NO: 15073 - DNA, 201 bp, Artificial Sequence
  Description of Artificial Sequence: Synthetic polynucleotide
attaygttyggttaattttttttttttgtatttttagtagagayggggttttatygtgttagttaggatggtttygattttttgattttataattygttygtttyggttttttaaagtgttgggatgataggtgggagttatygygttyggtttaatttagygttygatatttgaagaygatttgggttagaggagatygt

SEQ ID NO: 15074 - DNA, 201 bp, Artificial Sequence
  Description of Artificial Sequence: Synthetic polynucleotide
agygagtygtygatgttagygagatgttaggttggatttagtaagtygtygatgttagttagaygtagagtagagaaygttggttaaagagtagttaggyggtgtttgttyggtygaagtttagtttyggagaggtaggttttgtattaggaygtggaggtttyggggttatgaaatttttagggtgagagataaaggtag

SEQ ID NO: 15075 - DNA, 380 bp, Artificial Sequence
  Description of Artificial Sequence: Synthetic polynucleotide
tttttttttttttttttagayggagtttagttttgtttttatgttgtagggtagtggygyggtttyggtttattgtaattttygtttttygggttttygygatttttttgttttagtttttygagtagttgggattataggtataygttattaygtttagttaatttttgtttgtttgtttatttatttattattatttttgagayggagtttygttttgttattaggttggagtgttattggagtgtaatggtaygatttyggtttattgtaattttygtttttygggtttaagtaatttttttgttttagtttttygtgtaattgggattataggtaygtgttattatttttagttaattttttgtattttagtagag

SEQ ID NO: 15076 - DNA, 201 bp, Artificial Sequence
  Description of Artificial Sequence: Synthetic polynucleotide
gagtgtaatggygygatttyggtttattgtaagtttygtttttygggtttaygttatttttttgttttagttttttaagtagttgggattagaggtgttygtygttaygtttagttaattttttgtatttttagtagagayggggttttatygtattagttaggatggtttygattttttgatttygtgattygttygttt

SEQ ID NO: 15077 - DNA, 201 bp, Artificial Sequence
  Description of Artificial Sequence: Synthetic polynucleotide
tatagggtgtygaaattaagttatttagggagttygtagattttatttttttyggtgagagagtttggtggggagtattttatttaatgtagggaatagygttattgyggtttttatttttyggttttaagtgatttatttgtygtagttttttaagtagttgggattataggygygtgttattaygtygggttagttttt

SEQ ID NO: 15078 - DNA, 201 bp, Artificial Sequence
  Description of Artificial Sequence: Synthetic polynucleotide
ttttttttttgggggtttttttatgttttatgtagtttatggtgtggggtttattggttttggyggggtggaaggttttatgtygtygtygttttaygtygtyggtggtgggggtttgttgggggttgggaggaaggtaaataggaagggtttatyggggagagggtgggggagtaygttatagtygtygtagttygtygt

SEQ ID NO: 15079 - DNA, 201 bp, Artificial Sequence
  Description of Artificial Sequence: Synthetic polynucleotide
tttaggtgygttygttatttttttgattyggaaagggaattttttgattttttgygttttttaagtgaggtaatgttttattttgtttyggtttaygtayggtgtgygtatttattgatttgtgtttattgtttggtattttttagtgagatgaattyggtattttagatggaaatgtagaaattattygttttttgygtc

SEQ ID NO: 15080 - DNA, 201 bp, Artificial Sequence
  Description of Artificial Sequence: Synthetic polynucleotide
ggttgtagtgtagtggygygattttygtttattgtaagttttttttttygggtttaygttatttttttgttttagtttttgagtagttgagattataggygttygttattatattyggttaattttttgtaaaaaatttaaaaaaaaaattaaagataaaatgggttyggtagtatgatattttttatttttaattatttg

SEQ ID NO: 15081 - DNA, 201 bp, Artificial Sequence
  Description of Artificial Sequence: Synthetic polynucleotide
ttttgttttttttaagygtyggttaggttgagaaataaagggatagagtataaaagagggaaattttaaagtygggtattygggggagatattatatgtyggtaggttttgtgatgtttttgagtygtaaaattagtaagtttttattagggatttttaaaaggggagggagtgtaygaatagggtgtgggttatagagat

SEQ ID NO: 15082 - DNA, 201 bp, Artificial Sequence
  Description of Artificial Sequence: Synthetic polynucleotide
agtagtgtttttataaataggygtgaaaatygagtatgttttgggttggttagttgaattattgygtgtagagagggagttttggtygtataggtatagyggyggattatgtttttatatatgtygtttgtatagaaaatggagaataagtttttttttgggtygggtttttaagattataataataagagttygttaaag

SEQ ID NO: 15083 - DNA, 201 bp, Artificial Sequence
  Description of Artificial Sequence: Synthetic polynucleotide
ttttaggggttttaaatyggagttttatttttaggatttataaaattttagatatagttaggatttgttagggagattagtttttttyggtagtttgggygttgttgtttttaatatatagtgataattyggaatttatttttagagttatttagaaataygttttggagatggtgtttttygaaagatttttatttttaa

SEQ ID NO: 15084 - DNA, 201 bp, Artificial Sequence
  Description of Artificial Sequence: Synthetic polynucleotide
ggatgtttggttatatttgattttttatttttgggtatggaggtttgtttgtagaggttygggttygggtataaagggagagagaggtttttattgtttygtaggggtygaaatgtagatygtgtattttyggtgatttyggggatttttttttgattattaggatttttttggattttagggtttttgttttgtttaggt

SEQ ID NO: 15085 - DNA, 201 bp, Artificial Sequence
  Description of Artificial Sequence: Synthetic polynucleotide
ttagtagagayggggttttatygtgttagttaggatggtttygattttttgatttygtgattygttygtttyggttttttaaagtgttgggattataggygtgagttatygygttyggttatttattttttttaagagatggttgatatgattttaatttttttaaatttttgaagatttgttttgtgatttagtatgtga

SEQ ID NO: 15086 - DNA, 568 bp, Artificial Sequence
  Description of Artificial Sequence: Synthetic polynucleotide
aggtggagttgtttgttagttyggygtygtgtgttygtattttttagtttttgggtagtygatgggattgggygtygtggaataggggttggygttygtyggggaggtttgggttgtataggagygtayggygggggtggaggtttaggtatggagggttgtaggtttygagttttgttyggyggggaggtagttaaggtttagygagaagtygagtatagtagttgttggtttaggtgttaagttttttattgttygggtyggttggtygtttygagtgyggggtttgttaagtttaygtttattyggaattygagttggttygtaagygtagtttgtagttayggttttygtttaygtttttttttttatatttattygtaagttgagggagtyggttttagttttgtttagtttagaaaggggtttttatagtgtagygaygggttgaagggttttttaaaygyggttagagtgggygttaaggtygaggaggtgtygagagggagygagggttgtgagggttgttagtaygttgttattttttatttttgtgtttgtatattaa

SEQ ID NO: 15087 - DNA, 201 bp, Artificial Sequence
  Description of Artificial Sequence: Synthetic polynucleotide
ttttttttttttttttttttttttttttttttgagayggattygtgttttgtygtttaggttggagtgtagyggygygattttygtttattgtaagtttygtttttygggtttaygttatttttttgttttagtttttygagtagttgggattataggtatttattatgatgtttagttaattttttgtatttttagtaga

SEQ ID NO: 15088 - DNA, 201 bp, Artificial Sequence
  Description of Artificial Sequence: Synthetic polynucleotide
attttagagaagtttatgggagttttagggagagttttttttgtgaagggtagggtattttggaatgggtttgtygagttygtttttattyggaatttaygtttgtttataagygttttatatagttttggtttttatttgygtttttttttttatattttttygtaagtagagggagttaatttyggttttggttagttt

SEQ ID NO: 15089 - DNA, 201 bp, Artificial Sequence
  Description of Artificial Sequence: Synthetic polynucleotide
ggataaagaaaatgtggtatatggttgggtayggtggtttaygtttgtaatttyggtattttgagaggttaaggygggtagattaygaggttaggagatygagattattttggttaataygatgaaattttatttgtattaaaaaatataaaaaattagttaggtatggtggygggtgtttgtagttttagttatttggga

SEQ ID NO: 15090 - DNA, 201 bp, Artificial Sequence
  Description of Artificial Sequence: Synthetic polynucleotide
ttgtattttagtttgggggatagagtgagatttygttttaaaaaagaaagaaaaaaatgtttttttttttttgttttttttgatttttattttgttttgygggttttttattaataatygttygtgtttgattygggtgttttttttattataattttttttttaggtgtatgtttttataataaagtttattttatggtt

SEQ ID NO: 15091 - DNA, 201 bp, Artificial Sequence
  Description of Artificial Sequence: Synthetic polynucleotide
ttagttttatttatgygttatttatggataagggtaattattagtagtagtgattatgtgtgttaggtattygtaggttttttttygttttttgaattaygtgttaygtttagtttagggatgataaattgaggtgtaygagtaggtgagaagaygaatagtgtattygggtaaggtygttagtttttttgtgtttttgtg

SEQ ID NO: 15092 - DNA, 201 bp, Artificial Sequence
  Description of Artificial Sequence: Synthetic polynucleotide
ttattattgatatttattttttttttatttatagtattygtatgtaygttaagaatyggattggtaagagygagtttagtaaygagtttattattayggyggaygaggtaggtaygtgggatygggyggaattttgttttagaggagttygggagttaatttttgagggtttagatgtttaaatgtagaagtagatttttg

SEQ ID NO: 15093 - DNA, 201 bp, Artificial Sequence
  Description of Artificial Sequence: Synthetic polynucleotide
gygggaggygygtaagtgatatattgaggggtttaggtagtagtttttataygttgttaggttagagtagtttygggttaygtgggtgtttttagttgtygttgtaggyggaggtaygtyggttttttaaggatgtgatagyggttggatttttatgattattgtttggttattagagggtaagttttagggttagttaag

SEQ ID NO: 15094 - DNA, 201 bp, Artificial Sequence
  Description of Artificial Sequence: Synthetic polynucleotide
gggtyggtttygggtygtttggggtttttgygatttttatatttatttttttygtagggtgyggygttgggttttatggtgggttttatgatttaygggyggygttaattttagtttttggataygaygatgyggygtttgatttygttttttygygaggtttyggttaagttaattaygttggtggatgtygaygtygag

SEQ ID NO: 15095 - DNA, 201 bp, Artificial Sequence
  Description of Artificial Sequence: Synthetic polynucleotide
taatattgtttgtaaatgattgaatyggtttttgatttttttagagaagatygtgtatagatattyggatgattttattagttaggaaattgagyggggygggaygtatttgtagtagtggtyggatagygtgattatgtaggatggayggtttagatggttatgttgtagtttattagtagtaggtttttaaggtgatta

SEQ ID NO: 15096 - DNA, 201 bp, Artificial Sequence
  Description of Artificial Sequence: Synthetic polynucleotide
tyggatagtaaataygygtgggttttttttgtgtyggatagtaaataygygtgggtttttttgtgttaaayggtaaataygygtgggtttttygtgtgtygaatagtaaataygygtgggttttttttgtgttygatagtaaataygygtgggtttttygtgtgtyggatgataaataygtatgggtgttttgtgtgttgg

SEQ ID NO: 15097 - DNA, 201 bp, Artificial Sequence
  Description of Artificial Sequence: Synthetic polynucleotide
gttttattatgttggttaggttggtttttttaatttttgatttygtgatttatttatttyggttttttaaagtgttgggattataggagtgagttattgygttyggttgagatttttatgttattattttatgaagtttttggtataatgtttgatatatagtaggtatttgataagtggagtttttattgttgttttttt

SEQ ID NO: 15098 - DNA, 201 bp, Artificial Sequence
  Description of Artificial Sequence: Synthetic polynucleotide
gagttaggtgtgggatatagtttygtggtgygtygttttttaagttygtyggaaaagygtagtattygggtgggagtgattygattttttaggtgygttygttatttttttttttgattaggaatgggaattttttgatttttygtgtttttygagtgaggtaatgtttygttttgtttyggttygygtayggtgygtgta

SEQ ID NO: 15099 - DNA, 201 bp, Artificial Sequence
  Description of Artificial Sequence: Synthetic polynucleotide
ttttttggagttaattgtgtttttattattttaaatagagtagtygggatygggygttgtgttttaygtttataattttagtattttgygaggtygaggygggtagattaygaggttaggagatygagattattttggttaatatggtgaaaatttgtttttattaaaaatataaaaaatttttygggygtggtggygggc

SEQ ID NO: 15100 - DNA, 201 bp, Artificial Sequence
  Description of Artificial Sequence: Synthetic polynucleotide
tygatagagtgaaatggyggyggyggtygggatgatgttgttgggtttgttataggygggtgggtaggtgttgggttaggygatggaggaggtggtaggyggtaattttttgtttatgttgttgatygtttgygtttttatttttagtttggtttatttgtttygtttygttgtyggttatttggtttagttgatygtagg

SEQ ID NO: 15101 - DNA, 201 bp, Artificial Sequence
  Description of Artificial Sequence: Synthetic polynucleotide
gtgaaattttgtttttattaaaaatattaaaaaaattagtyggygyggtggtaggygtttgtagttttagttattygtaaagttgaggtaggagaatggygtgaattygggaggyggagtttgtagtgagttgagatygygttttygtattttagtttgggtgatagagygagattttgttttaaaaaaaaagtagtttgg

SEQ ID NO: 15102 - DNA, 201 bp, Artificial Sequence
  Description of Artificial Sequence: Synthetic polynucleotide
tttttatttttgtttttgagatggagttttatttttatttaggttggagtgtagtagtatgatttgggtttattgtaatttttgtttttygggtttagtygatttttttgttttagttttttaagtggttggaattataggtatatattattatattyggtaaatttttttttttttttttttgtatttttagtagattgt

SEQ ID NO: 15103 - DNA, 201 bp, Artificial Sequence
  Description of Artificial Sequence: Synthetic polynucleotide
tatggtgaaatttygattttgttaaaaatataaaaattagtygggygtggttgtgagtatttgtaattttagttatttgggaggttgaggtaggagaatygttagaattygggaggtggaggttgtagtgagttaagatggtattattgtattttagtttgggtaatagagtgagattttattttaaaataaaaaaaaata

SEQ ID NO: 15104 - DNA, 201 bp, Artificial Sequence
  Description of Artificial Sequence: Synthetic polynucleotide
atttgttttaaggattggaagaggaaaattaaaaatattatttgaaaggtyggaygyggtggtttatatttgtaattttagtattttgggaggttaaggygggyggattaygaggttaggagttygagattagtttggttaatataatgaaatttygtttttattaaaaatataaaaattagttgggtttggtggtaggta

SEQ ID NO: 15105 - DNA, 201 bp, Artificial Sequence
  Description of Artificial Sequence: Synthetic polynucleotide
tgtagtggtataatttttgtttttgtaatttttttttttyggttttaagygattttygygttttagtttttaagtagttgggattataggttygagtttygttyggttaattttttttatatttttagtagagatggggttttattatgttggttaggttggtttygaatttttgattttaagtgattygtttattttggt

SEQ ID NO: 15106 - DNA, 201 bp, Artificial Sequence
  Description of Artificial Sequence: Synthetic polynucleotide
aataygggtggtttygygtaggaygggggttttagggtygtttgagtyggaggatagttygtagtttttatygtttgtagttgaagtgtgttgtgagatygttgtaggggttygggttatttttgttttgggggattttaaaaagttgagttatatttatgttgaaatttttattgaggataattaygtattatatagatt

SEQ ID NO: 15107 - DNA, 201 bp, Artificial Sequence
  Description of Artificial Sequence: Synthetic polynucleotide
agttttygttgattttagtaygagtygtttatatatatttaaggtyggtagtatagyggtatatgtggtaaaatygagtaggygtggatgggaagggagygtattagtttgygtgtgaaggttatatttaggggyggagggaggggagaaatatttttgtygtatttgtagtgttttattttttttagtaatttaaaaygt

SEQ ID NO: 15108 - DNA, 234 bp, Artificial Sequence
  Description of Artificial Sequence: Synthetic polynucleotide
ttttgttgaygtagtgttygtygtygtttttggatgattttagtggtgaagtggtgtattatgttataggtttgtyggaattttygtttattygtygagyggtagtaaatgaagtygaggtagtggtgtaagygatattggygtyggatagatagagygtttagtttaatgatagyggagatataattatttatttttttgttaaggagaaggggatttatgagtgtagttttt

SEQ ID NO: 15109 - DNA, 201 bp, Artificial Sequence
  Description of Artificial Sequence: Synthetic polynucleotide
tagtttttttatttgtgtagtgggygtaatgtygatgattgttttygggaagttagayggtgtttgggaggygttgagttggggttgatatagagygagygtttygtgaagtatttgggttttgtgatgtttttaagtttatagaygtattaygttatgaggaatatatttgggttggygatgttggagataagggatttt

SEQ ID NO: 15110 - DNA, 201 bp, Artificial Sequence
  Description of Artificial Sequence: Synthetic polynucleotide
tagtgagtatagatygygttattgtattgtagtttgggtgatagaagtgaaaagaaatattgttttaaaaaaaaaataggagggaggagttaagatggtygaataggaatagtttyggtttatagtttttagygtgagygaygtagaagaygggtgatttttgtatttttatttgaggtatygggtttattttattaggga

SEQ ID NO: 15111 - DNA, 201 bp, Artificial Sequence
  Description of Artificial Sequence: Synthetic polynucleotide
gatgaaatttygtttttattaaaaatataaaaatttagtygggygtggtggyggaygtttgtagttttagttatttaggaggttgaggtaggygaatggygtgaattygggaggyggagtttgtagtgagtygagattgygttattgtattttagtttgggygatagagygagattttgttttaaaaataaaataaaatta

SEQ ID NO: 15112 - DNA, 201 bp, Artificial Sequence
  Description of Artificial Sequence: Synthetic polynucleotide
gtgagtgtggggtttagttggttgttttaagtatyggtatataggtaggttttaggtagggtttgtagttggattaggtatgttatttygaagggaatgyggtggtattttaagaggggtgtttagattttgaagtttyggaaggggygattttatttgttaattagtttttttagttttgttattygtagttttagggat

SEQ ID NO: 15113 - DNA, 201 bp, Artificial Sequence
  Description of Artificial Sequence: Synthetic polynucleotide
gtgyggttttttagttagggtagttygaaatttaggaaygttttaaggttattttgtgggaattgtggygttagggtttttgaatatttttttgtttttygagtygagtygttttatttgttttttaaaygggtttygggaggaaggttygygtgtttttttaaggtgaggagttattgatgtaaattttttgtaaggatt

SEQ ID NO: 15114 - DNA, 201 bp, Artificial Sequence
  Description of Artificial Sequence: Synthetic polynucleotide
ggggatttagtttaygtgtgtgggggtygtgygtgttygtttygtttgtttatgtatgttatatatgtgagagtttatagygagggtagtttttataygygatggtttagaggagygagtattttaggttttttagtaygtttttgtgttgattttttgtagtattgtygggagttatgtgagtgtttaygtttgtgtgtg

SEQ ID NO: 15115 - DNA, 201 bp, Artificial Sequence
  Description of Artificial Sequence: Synthetic polynucleotide
tttattygtttttygtttttttttttgttggatttgaggygtygttttygtygygttgttttygygttatgttaygttaygttaygttaygttaygttaygtttttaygttaygtttaygttaygtttttatttttygtttatagggaaaygggtttyggygatgtgagggygtttgtygtgtttggtgtttttatagggg

SEQ ID NO: 15116 - DNA, 201 bp, Artificial Sequence
  Description of Artificial Sequence: Synthetic polynucleotide
agtttttaaagttttaatttttttttttttttttttttttttttttttttttttttgagtyggagttttattttgttgttaggttggagtgtagtggygygattttagtttattgtaatttttgygtttygggtttaagggatttttttgttttagttttttgagtagttgagattgtaggtaygtgttattaygtttagt

SEQ ID NO: 15117 - DNA, 201 bp, Artificial Sequence
  Description of Artificial Sequence: Synthetic polynucleotide
ttgtaggatagttttaaaaaggaaggttattttttttttgtttattatygtagtttgttaattaattagaaggtaggygttgagatagtaataattagtygatagttgyggaggattgtygggatttttatagagttygataagtgggattatagttattattagttattgagaagagtgttttttatttatagagtgtaa

SEQ ID NO: 15118 - DNA, 201 bp, Artificial Sequence
  Description of Artificial Sequence: Synthetic polynucleotide
ttaaatttttagagggtttattgtaagatttttttygggtttgaaagtttaagatgaataatttttttttttttaggtttagttttaaggygtaatttgygttagtagggtgygttagtagggtgygttagtagggtgygttagtagggtgygttagtagggtgygttagtagggtgygttagtagggtgygttagtaggg

SEQ ID NO: 15119 - DNA, 686 bp, Artificial Sequence
  Description of Artificial Sequence: Synthetic polynucleotide
attatgttttagtttttttggtygtttttatttttaaatattygaaaaatagaggygttgggtgygaggyggagagatgtataggtttggtttyggtttygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygtgagttttgttttgttttgtattaagtttgtattttttaggtttttggtatttttgtttttgggaygtggggtttttatagatttggaaatttttgtttgtttttttttatttagagtaaattgagaygtttataagagtttggaagttgtttttttttgggtttgaagtygtttggaggttggtttygttttyggtttttttgttatagggtaatgtatatattttttatygtatagtttttttgtttaaaattttgttgatttattttgttttttgttttttaaagtttttattygtgygttggattttygttttgggygttttttagttttygtyggttttttttggagygtagygtyggggttttagttttggggaggttgggttttttgtttggttttgggagtttgtaggtgttat

SEQ ID NO: 15120 - DNA, 201 bp, Artificial Sequence
  Description of Artificial Sequence: Synthetic polynucleotide
aggttggtagattaygaggttaggagatygagatygttttggttaatatggtgaaatttygtttttattaaaaatataaaaattagtygggygtggyggygtgtttttgttttagttgttggggaggttgaggtaggagaatggygtgaattygggaggyggagtttgtagtgagtygagatygtattattgtattttagt

SEQ ID NO: 15121 - DNA, 201 bp, Artificial Sequence
  Description of Artificial Sequence: Synthetic polynucleotide
tattgtaagtttygtttttygggtttaygtygttttgttgatttygtgattygtttygtttyggttttttaaagtgttgggattataggygtgagttatygygttyggttaatagtttttaatattaattatttagagtgtgtaataatttggaaaagggtttttttttttttttttgtttttagagatagggtttttggt

SEQ ID NO: 15122 - DNA, 201 bp, Artificial Sequence
  Description of Artificial Sequence: Synthetic polynucleotide
tgggagtgattygatttttaaggtgygttygttatttttttttttgatttagaaagggaattttttgattttttgygttttttaagtgaggtagtgtttygttttgtttyggttygtatayggtgtaygtatttattgatttgygtttattgtttggtattttttagtgagatgaattyggtattttagatggaaatgtag

SEQ ID NO: 15123 - DNA, 201 bp, Artificial Sequence
  Description of Artificial Sequence: Synthetic polynucleotide
attttataaaaatgaaaattaaataagtataagaatggttatatttgggggaggagttaatatggtygaataggaatagtttyggtttatagtttttagygtgagygatatagaagatggtgatttttgtatttttaattgaggtatygggtttattttattagggattgttagatagtgggygtaggttagtgggtgygt

SEQ ID NO: 15124 - DNA, 201 bp, Artificial Sequence
  Description of Artificial Sequence: Synthetic polynucleotide
yggggttttattttgttagttaggatggtttygattttttgatttygtggttygtttgtttyggttttttaaagtgttgggattatagatttgaattatygygtygggttagttttgtgggtttttaaygtgtttttttttatttgtaatttagagttagaagaggttagygttgataggtaggtagtagttatatgaaaa

SEQ ID NO: 15125 - DNA, 201 bp, Artificial Sequence
  Description of Artificial Sequence: Synthetic polynucleotide
ttattaaaaatataaaaaattagtygggygtggtggtgggygtttgtaattttagttattygggaggttgaggtagaagaatggtatgaatttaagaggyggagtttgtagtgagtygggatagygttattgtagtttagtttgggygaaagagtgagatttygttttaaaaaaaaaaaaaaaaaaaaaaaaaaaagattt

SEQ ID NO: 15126 - DNA, 201 bp, Artificial Sequence
  Description of Artificial Sequence: Synthetic polynucleotide
ggagggtggtgagggtggggagggggaaggygggaggtygggttyggtgtatgggggtygggtatattttttttgggtatttttaggataggygaggaaygtatyggtygggattttatttaygagtaggagggtaaggtgtagtttgtgattgatgyggtgtaygttattgtttaygttttttatagtatgtattaggyg

SEQ ID NO: 15127 - DNA, 201 bp, Artificial Sequence
  Description of Artificial Sequence: Synthetic polynucleotide
ttatataagtygtagtttgggtagaygttgtatttgtagygggtttttattataggtttattgtagttatygtagattatattggggtgtattatgttgyggggygttttttgagtatayggtgggyggtggtttygtyggtatttttttttttttataggaagggtaaagagagtygttagggtgggattttttaaagtt

SEQ ID NO: 15128 - DNA, 201 bp, Artificial Sequence
  Description of Artificial Sequence: Synthetic polynucleotide
tatggggaaattttgtttttattaaaaatataaaaattagttyggygtggtggtatataattgtaattttagttattygggaggttgaggtaggagaatygttggaattygggaggyggagtttgtagtgagttaagattgygttatgtattttaatttgggygtygtagygagattttgtttttaaataaataaagtgtt

SEQ ID NO: 15129 - DNA, 201 bp, Artificial Sequence
  Description of Artificial Sequence: Synthetic polynucleotide
agtaattaataaagtgaagatatggtttattgaagygtagaaaatatttataagtygggygyggtagtttaygtttgtaattttagtattttgggaggtygagataygyggattataaggttaggagatygagattattttggttaatatagtgaaattttgtttttattataaatagaaaaaattagttgggtatggtgg

SEQ ID NO: 15130 - DNA, 227 bp, Artificial Sequence
  Description of Artificial Sequence: Synthetic polynucleotide
agattggttttttttatttaataatatgtattttaatttttagggttgggygtggtggtttaygtttgtaattttagtattttgggaggtygaggtyggyggattaygaggttaggagattaagaygattttggttaatatggtgaaatttygtttttattaaaaatatagaaaataagtygggygtggtggygggtatttgtagttttagttatttaggaggttga

SEQ ID NO: 15131 - DNA, 201 bp, Artificial Sequence
  Description of Artificial Sequence: Synthetic polynucleotide
gtttttttttygagttaaagaaaggggtgayggaygtatttggaaaatygggttatttttattygaatattgygttttttygatyggtttaaaaaayggygtattaygagattatattttatatttggttyggagtttygttgattgttagtatagtagtttgagattaaattgtaaggtggtagtaaggttgggggaggg

SEQ ID NO: 15132 - DNA, 201 bp, Artificial Sequence
  Description of Artificial Sequence: Synthetic polynucleotide
aygtagaagaygggtgatttttgtatttttatttgaggtatygggtttattttatttgggagagttagatagtgggygtaggttagtgggggtatgtatygtgygygagtygaagtagggagaggtattgttttatttgggaagygtaaggggttagggagtttttttttygagttaaagaaaggggtgatagaygtattt

SEQ ID NO: 15133 - DNA, 201 bp, Artificial Sequence
  Description of Artificial Sequence: Synthetic polynucleotide
ggtattygttattaygttyggttaattttttgtatttatagtatagayggggttttatygtgttagttaggatggtttygattttttgatttygtgattygttygtttttgttttttaaagtgttgggattataggygtgagttatygygttyggtggaaaggatatttttttatagtatgagtattgaaataaaaaggta

SEQ ID NO: 15134 - DNA, 201 bp, Artificial Sequence
  Description of Artificial Sequence: Synthetic polynucleotide
aatygtgttattggaagttaggaagtaaattttaattttagtattgtttttttttgaaatggagtttygttttgttatttaggttggagtgtagtggygygatttyggtttattgtaagtttygtttttygggtttattttatttttttgttttagtttttygagtagttgggattataggtgttygttattaygttyggt

SEQ ID NO: 15135 - DNA, 201 bp, Artificial Sequence
  Description of Artificial Sequence: Synthetic polynucleotide
tttgggtgatygtttgtaatggagggagtgtgtgggttggtttgttagyggagagatttgttttaygttattaggagtttggtygagtattayggtgatygtggtygggtggaaggagatggaygtttatttgtgtaatttgtttttattttttttttaggggttattttagaataaaatgtaatggtttttttttgttta

SEQ ID NO: 15136 - DNA, 201 bp, Artificial Sequence
  Description of Artificial Sequence: Synthetic polynucleotide
ataagttggttgttyggtaggttatattggggtttttaagagtttgggttgtagaygaatttaggtttgttttttttaattagtgtgattygggtaagtygygttttttttttgagttttagtttttttattttttaaatgggggtgaygttatttttattgttaggggtttttttgagygggttataggaaggtgtttag

SEQ ID NO: 15137 - DNA, 201 bp, Artificial Sequence
  Description of Artificial Sequence: Synthetic polynucleotide
tttagtttgggatyggtagtatttttatttgtaygttatttttagggayggtaatattgtttattttgagtttagagtagttattattttyggttttttygttggttttttgggaggttttaggaagaygtgattttttgttaggtattygtgggtttttttatagttgtyggggtggtttttgtttttttaaaattatat

SEQ ID NO: 15138 - DNA, 201 bp, Artificial Sequence
  Description of Artificial Sequence: Synthetic polynucleotide
aaagttatygtaggtaattagaaaagttgtttttattttatggttgtgtttatttgyggtagataggataatggtttaaagatgtttgagattygtgatygttttattttgtgatygtattattttatatggtaaagaagtttttgtaygtgtgattaygattaaggattttgagattyggagatgatttgggtattyggg

SEQ ID NO: 15139 - DNA, 201 bp, Artificial Sequence
  Description of Artificial Sequence: Synthetic polynucleotide
gtggyggtaggtttgttgygttygttttagttagggtttagagtttttyggttagtttatygtatttggattttagatgggygygttgggtggtgttygygttagggaaagagttggyggttggttgagttgttgygtttttgagygttgtgttygttgtgattattggygtggttgtttttyggtaggttygaaggaatc

SEQ ID NO: 15140 - DNA, 201 bp, Artificial Sequence
  Description of Artificial Sequence: Synthetic polynucleotide
ttttygatattttgtttttatattgtattattygtyggtaatygttttyggatagyggttaggtygyggggaggttggttttggagtttattttyggggygtatattttygttaattttttygaggtggggtataggatygtggtgttgtattayggggatttgttttttttggggttttattatttgttgttatttaagg

SEQ ID NO: 15141 - DNA, 201 bp, Artificial Sequence
  Description of Artificial Sequence: Synthetic polynucleotide
gggtttagaggtattttagtaaatggtttaggaattgtagtattaatttatattgagaaatagaattgttatttaagaaagataattgttggtttaatgyggtggtttaygtttgtaattttagtattttgggaggtygaggttggyggattaygaggttaggagatygagattattttggttaatagggtgaaattttgt

SEQ ID NO: 15142 - DNA, 201 bp, Artificial Sequence
  Description of Artificial Sequence: Synthetic polynucleotide
tayggtgaaattttgtttttattaaaaatataaaaaattagttaggtgtggaggtattttttgtaattttagatatttaggaggttgaggtaggaaaatygtttgaattygggaggtggagtttgtagtgagttgatatygtattattgtgttttagtttgggtaatagagtaaaattttgttttaaaaaaaaaaaaaaaa

SEQ ID NO: 15143 - DNA, 201 bp, Artificial Sequence
  Description of Artificial Sequence: Synthetic polynucleotide
tatttttttgttttagttttaggagtagttgggattataggygttygttataaygttyggttaattttttttgtatttttagtggagayggggttttatygtgttagttaggatggtttygattttttgatttygtgatttattygttttagttttttaaagtgttgggattataggtgtgagttatygygtttagttgtt

SEQ ID NO: 15144 - DNA, 201 bp, Artificial Sequence
  Description of Artificial Sequence: Synthetic polynucleotide
gtttatagtttttagygtgagygatgtagaagaygggtgatttttgtatttttatttgaggtatygggtttattttattagggagggttagatagtgggygtaggttagtgggtgygygtatygtgygttagttaaagtagggtaaggtattgttttatttgggaagygtaaggggttagggagtttttttttygagttaa

SEQ ID NO: 15145 - DNA, 201 bp, Artificial Sequence
  Description of Artificial Sequence: Synthetic polynucleotide
tggtaaaattttatttttattaaaaatataaagatttagtatgggtatggtggtgtatatttgtaattttagttgtttgggaggttgaagtagaagaatygygtgaattygggaggtagaagttgtagtgagttaagattaygttattgtattttagtttgggtgatataaygagattttgtttaaaaaataaaataaaaa

SEQ ID NO: 15146 - DNA, 201 bp, Artificial Sequence
  Description of Artificial Sequence: Synthetic polynucleotide
aaattttttatttttttgaggtagagttttattttgtygtttaggttggagtgtagtagygtgatttyggtttattgtaagttttatttttygggtttaygttatttttttgttttagttttttgagtagttgygattataggtgttttttattaygtygggttaattttttgtatttttagtagagayggggttttattg

SEQ ID NO: 15147 - DNA, 201 bp, Artificial Sequence
  Description of Artificial Sequence: Synthetic polynucleotide
tttygagtagttgggattataggygttygttattaygttyggttaatattttgtatttttagtagagayggggttttatygygttagttaggatggtttygattttttgatttygtgatttgtttgtttyggttttttaaagtgttgggattataggygtgagttatygygttyggtttattttttttattttttatagag

SEQ ID NO: 15148 - DNA, 201 bp, Artificial Sequence
  Description of Artificial Sequence: Synthetic polynucleotide
tgagtygagyggagattgygttattgttttttagtttgggtgatagagggagattttgtgtttaaaaaaaatagatgtaggtaggagtttttttttyggygtttatatttagattgaagaaagtaattgggttgggttyggtggtttagatttgtaattttagtattttgggaggtttaggtagaygtattattttagttt

SEQ ID NO: 15149 - DNA, 201 bp, Artificial Sequence
  Description of Artificial Sequence: Synthetic polynucleotide
ttggagtagtggtaggtggtaagggttgggtggggggttgttttattgggttttttattttttttttttttttttaattttttttttttttttttgagayggagttttgttttgttatttaggttggagtaaagaggtatgatttyggtttatagtaatttttgtttttygggtttaagtgatttttttgttttatgtttt

SEQ ID NO: 15150 - DNA, 201 bp, Artificial Sequence
  Description of Artificial Sequence: Synthetic polynucleotide
tgaagggagggaygagagttttattatttaattttaagtttagtggtyggtgtttttggaagtggagatatatgtttattggtgtgygatttatatttaygaaagggaaygtgttttttggaatataggggagttttggttagggaagtygtttttttatttaagagggataaaggtgtgtaaattttagaaattagatat

SEQ ID NO: 15151 - DNA, 201 bp, Artificial Sequence
  Description of Artificial Sequence: Synthetic polynucleotide
aaattatttttgatttgagatataaaaataaagaggtygggygtaaggtggtttaygtttgtaattttagtattttgggaggtygaggygggyggattaygaggttagtagatygagattattttggttaatayggtgaaatttygtttttattaaataaaatataaaaaattagtygggygtggtggygggygtttgtag

SEQ ID NO: 15152 - DNA, 217 bp, Artificial Sequence
  Description of Artificial Sequence: Synthetic polynucleotide
ttttgaatgaaattaggaaggagaaagtatgggataatgggtttttgataatgataaaaagagaaaaaataaatagaaaaaagaggagggtyggtygggygyggttaggaaggygyggttttggttaggagatygagattattttggttaaygyggtgaagtttygtttttattaaaaatataaaaaattagtygggygtggtggggggygtttgta

SEQ ID NO: 15153 - DNA, 217 bp, Artificial Sequence
  Description of Artificial Sequence: Synthetic polynucleotide
tygttatttttttttttgattgggaaagggaattttttgattttttgttttttttaagtgaggtagtgtttygttttgtttyggttygygtayggtgtaygtatttattgatttgygtttattgtttggtattttttagtgagatgaattyggtattttagatggaaatgtagaaattattygttttttgygtygtttaagttgggagttgtagatc

SEQ ID NO: 15154 - DNA, 201 bp, Artificial Sequence
  Description of Artificial Sequence: Synthetic polynucleotide
tgttggtgggagttaaaatggattaattatataaaaaataatttttaggtygggygtagtggtttaygtttgtaatttyggtattttgggaggttaaggygggyggattaygaggttaggaaatygatattattttggttaataaggtgaaattttatttttattaaaaatataaaaatttagtygggygtggtggygggt

SEQ ID NO: 15155 - DNA, 201 bp, Artificial Sequence
  Description of Artificial Sequence: Synthetic polynucleotide
tggagattttttatttattgtggtagtaaattygtttgaggtgtttgtatgttttagtttyggggtttygggggtygtgtttatagtttttttatttttyggtttttaygttagggttttyggtttatatygtgttgttttgttttatatgagatyggaaagttatatgtggataatttaggatttatttagggttatata

SEQ ID NO: 15156 - DNA, 201 bp, Artificial Sequence
  Description of Artificial Sequence: Synthetic polynucleotide
gtagggttygaattttttttttaggagggttagggttgyggtygggygaygttaggtggggaagatattagaagaggagaaaattaggagygtaggaygyggtgggagattgggaggttgtagagaggaggtttgaggataggagggaaggaggyggggatagaggtygagggttggaggggttgtygggttttttttggg

SEQ ID NO: 15157 - DNA, 201 bp, Artificial Sequence
  Description of Artificial Sequence: Synthetic polynucleotide
gttatygygttyggttaatttttttgtatttttttagtagagtyggggttttatygtgttagttaggatggttaygattttttgattttgtgattyggtygtttyggttttttaaagtgttgggattataggygttaagttatygygttyggttgatagttagatttttaaaggtgtttgaatttttttaatgtggaaata

SEQ ID NO: 15158 - DNA, 201 bp, Artificial Sequence
  Description of Artificial Sequence: Synthetic polynucleotide
agtttaygtayggtgygygtatttattgatttgtatttattgtttggtattttttagtgagatgaattyggtattttagatggaaatatagaaattattygttttttgygtygtttatagtgggagttgtagatyggagttgtttttattyggttattttggtttgattyggagtggtataygtttttaaataattaaatt

SEQ ID NO: 15159 - DNA, 201 bp, Artificial Sequence
  Description of Artificial Sequence: Synthetic polynucleotide
ttggygagaagtygagtatagtagttgttggtttaggtgttaagttttttattgttyggggttgttggtygttttaagtgygggttagtttagtttaygygtattyggaagtygygttggtgagggagggttgygagggttgttagtatgttattattttttattgggattataggygtgagttayggygttyggttgaag

SEQ ID NO: 15160 - DNA, 201 bp, Artificial Sequence
  Description of Artificial Sequence: Synthetic polynucleotide
ttaygttatttttttgttttagtttgtagttgggattataggtgttygttattaygttyggttattttttttgtatttttaatagagayggggttttatygtgttagttaggatggttttaatttgttgatttygtgattygttygtttyggttttttaaagttttgggattgtaggagtgagttatygygttyggttgta

SEQ ID NO: 15161 - DNA, 201 bp, Artificial Sequence
  Description of Artificial Sequence: Synthetic polynucleotide
tagattggagtgtagtggtaygatttyggtttagaattttygttttatgggtttaagtaatttttttgttttagttttyggagtagttgggattataggygttygttattaygttaggttaattttttgtatttttagtagggayggttgatygggygyggtggtttaygtttgtaattttagtattttgggaggtygagg

SEQ ID NO: 15162 - DNA, 201 bp, Artificial Sequence
  Description of Artificial Sequence: Synthetic polynucleotide
tattttttagatgggatagyggtygggaagaggygttttttattttttagatgggatggyggttaggtagagaygttttttattttttagayggggtggyggtygggtagaggttgtaatttyggtattttgggaggttaaggtaggttgttgggaggtgaaggttgtagygagtygagattaygttattgtattttagtt

SEQ ID NO: 15163 - DNA, 201 bp, Artificial Sequence
  Description of Artificial Sequence: Synthetic polynucleotide
gatggagttgtttgttagtttyggtattgtgygttygtattttttagtttttgggtggttaatgggattgggtgtygtggagtagggggtggygttygtyggggaggttygggtygtataggagtttayggaaggggtgggaggtttaggtatggygggttgtaggtttygagttttgtttygygggaaggtagttaaggt

SEQ ID NO: 15164 - DNA, 286 bp, Artificial Sequence
  Description of Artificial Sequence: Synthetic polynucleotide
gagttaggtgtgggatatagtttygtggtgtatygttttttaagtyggtttgaaaagygtaataatygggtgggagtgattygattttttaggtgygttygttatttatttatttgattyggaaagggaattttttgattttttgygttttttaggtgaggtaatgtttygttttgtttyggttygygtayggtgygygtatttattggtttgygtttattgtttggtattttttagtgagatgaattyggtattttagatggaaatgtagaaattattygttttt

SEQ ID NO: 15165 - DNA, 201 bp, Artificial Sequence
  Description of Artificial Sequence: Synthetic polynucleotide
aggtaaagttgtttgttagttttatgttttgtgtttaygttttttagtygttttatagtygatgggatygggtgttatggagtagggggyggtgttygtyggggaggtttttgttgtataggagtttagggtagtggggggaggtttatatatggtaggttgtaggttttaagttttgtttygtagggaggtagttgaggt

SEQ ID NO: 15166 - DNA, 201 bp, Artificial Sequence
  Description of Artificial Sequence: Synthetic polynucleotide
aggygggtggattaygaggttaggggttygagaygagtttggttaatatggtgaaatttygtttttattaaaaatataaaaattagttgggygtggaggygygygtttgtaattttagatattygggaggttgaggtaagagaatygtttgaattygggaggyggaggttgtagtgagtygagatggtgttattgtatttt

SEQ ID NO: 15167 - DNA, 201 bp, Artificial Sequence
  Description of Artificial Sequence: Synthetic polynucleotide
gagygaygtagaagaygggtgatttttgtatttttatttgaggtatygggtttattttattagggagtgttagatagtgggygtaggttagtgggtgtgygtaatgtgygygagtygaagtagggygaggtattgttttattygggaagygtaaggggttagggagtttttttttygagttaaaggaaggggtgayggagg

SEQ ID NO: 15168 - DNA, 201 bp, Artificial Sequence
  Description of Artificial Sequence: Synthetic polynucleotide
gtgtygtttgttatttttttttttgattaggaaagggaattttttgattttttgygttttyggagtgaggtaatgtttygttttgttttagttygtatayggtgtatgtatttayggatttgygtttattgtttggtattttttagtgagatgaattyggtattttagatggaaatgtagaaattattygttttttgygtt

SEQ ID NO: 15169 - DNA, 201 bp, Artificial Sequence
  Description of Artificial Sequence: Synthetic polynucleotide
atttttatttgaattttgatagtagttattatgtagagttgttaaaatgtatatttttggtygggtgyggtggtttaygtttgtaattttagtattttgyggggtygaggygggyggattaygaggttaagagattaagattattttggttaatatggtgaaattttgtttttattaaaaatataaaaaaaattagttggg

SEQ ID NO: 15170 - DNA, 201 bp, Artificial Sequence
  Description of Artificial Sequence: Synthetic polynucleotide
ttaggtgttattygttatttttttttttgatttagaaagggaattttttgattttttgygttttttaggtgaggtaatgtttygttttgtttyggttygygtayggtgygtatatatattggtttgygtttattgtttggtattttttagtgagatgaattyggtattttagatggaaatgtagaaattattygttttttg

SEQ ID NO: 15171 - DNA, 201 bp, Artificial Sequence
  Description of Artificial Sequence: Synthetic polynucleotide
tttagtttatygttgtattgtgagagtttttttttgggttggttaaggttagagttygtttttttagtttgtagggaggtgtggatggagaggygtgagygggaatttaggttgtgtatggtgtttgygggttagttggagtttygggtgggygtgggtttggtaggtttygtattgggagtagtyggtyggttttgttag

SEQ ID NO: 15172 - DNA, 201 bp, Artificial Sequence
  Description of Artificial Sequence: Synthetic polynucleotide
ggggagagggattgattttttgtgttttatttttagtttatttaattttagtgtagtttggagattgttatygtgtttttyggagggygatggagttttygttttgtttaggagtagtttggttttygggagggtagtttgatttttayggtattgtyggtgattttttagtttaggtttyggggttgygagaattttaag

SEQ ID NO: 15173 - DNA, 201 bp, Artificial Sequence
  Description of Artificial Sequence: Synthetic polynucleotide
atgagygttatygayggtagagtygttttttttatgttttgtggggatygggaagagatygtagggagtgaggtattttattygtttattyggtagattygaagattgagattygagagttygtagtttygggttatatttttagygtttggtttagttttttttttatttttttattygttttttgtagaygaggggttt

SEQ ID NO: 15174 - DNA, 201 bp, Artificial Sequence
  Description of Artificial Sequence: Synthetic polynucleotide
gttgtaattttattgagtgtgtttgtttattagatatttgattttgtaagattgttttttttttttttttttgayggagtttygttttgtygtttaggtygaagtgtagtggygygatttyggtttattgtaagtttygtttttygggtttatgttatttttttgttttagtttttygagtagttgggattataggygttc

SEQ ID NO: 15175 - DNA, 210 bp, Artificial Sequence
  Description of Artificial Sequence: Synthetic polynucleotide
ttttgggtttttattttttttttttttttttttttttttttgagaygaagttttattttgtygttygggttggagtgttgtggtaggatttyggtttatygtaagtttygtttttyggatttaygttatttttttgttttagtttttygagtagttgggattagaggygttygttatygygttaggttaatttttttgtatttttagtag

SEQ ID NO: 15176 - DNA, 201 bp, Artificial Sequence
  Description of Artificial Sequence: Synthetic polynucleotide
taagttgggygyggtggtttaygtttgtaattttagtattttgggaggtttaggtaggyggattaygaggttaggagattaagattattttggttaatayggtgagaatttygtttttataaaaaatataaaaaattagtygggtgtttgtagttttagttattygggaggttgaggygagagaatggygtgaattygggg

SEQ ID NO: 15177 - DNA, 201 bp, Artificial Sequence
  Description of Artificial Sequence: Synthetic polynucleotide
gggttaaagaggaatyggaaagggttyggggtagaygtgggygttatagggtgagtygggttaggttgagaggatttaygggttatgggagtttgtgggygayggttyggtaggggtttgyggygggaatagggataaaatatatttaataaattgtttatttagagtaagttgtgtgggtataatggygagaaaayggtt

SEQ ID NO: 15178 - DNA, 201 bp, Artificial Sequence
  Description of Artificial Sequence: Synthetic polynucleotide
ggygggtgggttaygaagttaggagatygagattattttggttaatatggtgaaattttatttttattaaaaatataaaaaattagtttggtatagtggygggygtttgtagttttagttagttyggaggttgaggtaggagaatggygtgaattygggaggyggagtttgtagtgagtygagattgygttattgtattat

SEQ ID NO: 15179 - DNA, 201 bp, Artificial Sequence
  Description of Artificial Sequence: Synthetic polynucleotide
gtttatgttattttaatagtgggttttttttyggtgagaattggttaatagttattgtttygtttttttagtatgttgtttgattagagagggatagggyggggaggaaaatyggggygtygtgggttgtagttttagttgtaaataygggagtttttttygaygtttgtggttygtyggttygaaagggagaaataygga

SEQ ID NO: 15180 - DNA, 201 bp, Artificial Sequence
  Description of Artificial Sequence: Synthetic polynucleotide
ttatgaatttttgagtttaagtgatttttttatttggttttgygaagtgttgggattatatgtgtgagttattaygtygggattataggtgtgagttatygygtygggattatgggtatgagttattgygtyggtttttagtaaatattttattagtatttagtgaattttgggtttttgtggaataggaatgtttgtttt

SEQ ID NO: 15181 - DNA, 201 bp, Artificial Sequence
  Description of Artificial Sequence: Synthetic polynucleotide
aggttgaggttggtggattataaggttaggagatygagattattttggttaatatggtgaaatttygtttttattaaaaatataaaaaaattagtygggygtggtggtgtgtatttgtagttttagttattygggagtttgaggtaggagaatggtatgaattygggaggtagagtttgtagtgagttaaaattgtattat

SEQ ID NO: 15182 - DNA, 201 bp, Artificial Sequence
  Description of Artificial Sequence: Synthetic polynucleotide
aaggagatgtttgggttaggattgaagtttttyggaataaygggttgggattttgaggttggtaggggtgtagtgggtattgggtttatgtgtggtttgygttggtygaygtgggtatataaggggtatagttgttattgggggtttggaggggaggatttagttggggtttggagggttaggattttgtagaaggtttac

SEQ ID NO: 15183 - DNA, 201 bp, Artificial Sequence
  Description of Artificial Sequence: Synthetic polynucleotide
tatggtgaaatttygttttaattaaaagtattaaaattatttgggtatggtggtatatgtttgtaattttagttattygggaggttgaggtaggagaatygtttgagttygggaggyggaggttgtagtgagtygtgatygygttattgtattttagtttgggygatagagtaagattttattttaataaaaaaattaaaa

SEQ ID NO: 15184 - DNA, 201 bp, Artificial Sequence
  Description of Artificial Sequence: Synthetic polynucleotide
gygatttttttgttttagtttttygagtagttaggattataggygttygtttttaygttyggttaattttttgtatttttggtagagayggggttttatygtgttagtaaggatagtttygattttttgatttygtgattygtttgtttyggygttttaaagtgttgggattataggtatgagttatygygtttggtgggg

SEQ ID NO: 15185 - DNA, 201 bp, Artificial Sequence
  Description of Artificial Sequence: Synthetic polynucleotide
agtgaaatttttttttattaaaaatttaaaaaaattagtygggtgtggtagtatgtgtttgtagttttagttattygagaggttgagataggagaatggygtgaattygggaggyggagtttgtagtgagtygagatygtgttattgtattttagygtgggygatagagtaagatttygttttaaaaaaaaagaaaataat

SEQ ID NO: 15186 - DNA, 201 bp, Artificial Sequence
  Description of Artificial Sequence: Synthetic polynucleotide
agattatagatgaatttgaattttaagtagtatagatgygttatatttattattttgtygttgattattttygggattatattatatttattatttygtygttgattattttygggattattatggygggttatgatagtaygttttttttagaaataygtttgaatagtataagaaaaggatattattyggattygygga

SEQ ID NO: 15187 - DNA, 201 bp, Artificial Sequence
  Description of Artificial Sequence: Synthetic polynucleotide
ygttgttatttataagagtttttttttttttgtaattaatggttttgtttttggtttgtttagtaaattgaaattatygaaaaaggattttgtygggagyggtggtttaygtttgtaatattagtattttgggaggtygaggygggttgattataaggttaggaaatygagattattttggttaatayggtgaaatttagt

SEQ ID NO: 15188 - DNA, 201 bp, Artificial Sequence
  Description of Artificial Sequence: Synthetic polynucleotide
ttagagttaggygtttatygttaattyggagtgtgtgttttagttttttggggtygattttggttgttgggttagtagtgtgaattttttttttttatayggggtttttaagataygtgtttgtgtgtgttygtttttaagatatgtgtgtgtgtatatgtgtgtgtgtgtgtgtgttttatatgaaygatttgagttatt

SEQ ID NO: 15189 - DNA, 201 bp, Artificial Sequence
  Description of Artificial Sequence: Synthetic polynucleotide
gttagtgtttttayggtagtttttgtattgggttyggggtgggggyggggggtggttgtggagtttttggtttttatttagygtgttttttttayggggygtattttaaagygataagatgttttttaggaaatggggaatggaygttaggtttttagggagaggttgaggtagtttgaggtaaaaagggaygggtygagg

SEQ ID NO: 15190 - DNA, 201 bp, Artificial Sequence
  Description of Artificial Sequence: Synthetic polynucleotide
gggtgtttatggagtttttagtttttatttagggtgygtgttttttttayggggggtattttaaaggggtatgaagtttttygggggatggggatatgaygttaggtttttagtgggatattgagatagtygggggaaaaaagtygggagggtaagaaggttggggtatttttatggaggttagtttttttttagtagttt

SEQ ID NO: 15191 - DNA, 201 bp, Artificial Sequence
  Description of Artificial Sequence: Synthetic polynucleotide
gtatttattgttttgtattaattgtttagtattttttagtgagatgaattygttattttagttggaaatgtagaaattatttattttttgygtygtttaygttgggagttgtagatyggagttgtttttattyggttattttggttttattttattatattttttttatttagtttattattgatggatatttgggttggt

SEQ ID NO: 15192 - DNA, 201 bp, Artificial Sequence
  Description of Artificial Sequence: Synthetic polynucleotide
gtaggtgttagggagaggtaattttttaaatagataaaaatatttttggtygggygyggtggtttatgtttgtaattttagtatttygggaggtygaygygggyggattaygaggttaggagatygagattatttttgttaatayggtgaaatttygtttttattaaaaatataaaaaattagtygggtgtggtggygggc

SEQ ID NO: 15193 - DNA, 201 bp, Artificial Sequence
  Description of Artificial Sequence: Synthetic polynucleotide
tggttttattatgttagttaggatggttttaattttttgatttygtgattygttygttayggttttygaaagtgttgtgattataggtatgagttatygygttyggtttaaaataatttttgaggttatataagaatatagtttatgtttatttatagttgtatttaatttaattaagaatttgttttttaagatgaaaaa

SEQ ID NO: 15194 - DNA, 201 bp, Artificial Sequence
  Description of Artificial Sequence: Synthetic polynucleotide
ygggttttygatttgygtggatgagtagttttgagttttatatagggygggtgaygttgtagattgataaggtttatttttggttatattgagttaaagyggaaggggtgtaggtgtggagtgttatgtgygatgttattgtyggttagttggagtggaggtgttygttatgtgtatggggagaygtgtttttggttagtt

SEQ ID NO: 15195 - DNA, 366 bp, Artificial Sequence
  Description of Artificial Sequence: Synthetic polynucleotide
tygttttgtagtttgattttagattgttgtgttagtaattagtgagatttygtgggygtaggattttttaagttaggtgtgggatatagtttygtggtgygttattttttaagtyggtttgaaaagygtaatattygggtgggagtgattygattttttaggtgygtyggttatttttttttttgattyggaaagggaattttttgatttttggygttttttaggtgaggtaatgtttygttttgtttyggttygtttayggtgygygtatttattggtttgygtttattgtttggtattttttagtgaggtgaattyggtattttagatggaaatgtagaaattattygttttttgygtygttta

SEQ ID NO: 15196 - DNA, 201 bp, Artificial Sequence
  Description of Artificial Sequence: Synthetic polynucleotide
ggtttttgtagggtygagtttttttaatgagygttgttttttgttttayggygttyggttttatygatygtttaagggttgaggattgtgggagtattgygygggattggtaggtagttttatttgyggttttyggtgygggatttattgggtgaagttagttgggttygtgagtttagtgtggatttggagaatttttat

SEQ ID NO: 15197 - DNA, 201 bp, Artificial Sequence
  Description of Artificial Sequence: Synthetic polynucleotide
ygtagaagatgagtgatttttgtatttttatatgaggtatygggtttattttattagggagtgttagatagtgggygtaggatagtgggtgtagygtatygtaygygagtygaagtagggygaggtattgttttatttyggaagtataaggggttagggagtttttttttttagttaaagaaaggggtgatagayggtatt

SEQ ID NO: 15198 - DNA, 201 bp, Artificial Sequence
  Description of Artificial Sequence: Synthetic polynucleotide
tttttttttttagttaaagaaaggggtgatagatagtatttggaaaatygggttattttaatyggaatattgtatttttttaataggtttaaaaaayggygtatttggagattgtatttygtatttggttyggagggttttatgtttayggagtttygttgattgttagtatagtagtttgagattaaattgtaaggyggt

SEQ ID NO: 15199 - DNA, 384 bp, Artificial Sequence
  Description of Artificial Sequence: Synthetic polynucleotide
ttygtttttttggtttttgttgtttatgagaaatgaggaaaaataaaggttagatttttaataattttttyggaagaaagagttgttttgagtgggtgtyggtgtttatataygttgtttttaaaaaaatttgttttgtttaggtttgtgtgaatataaygtyggatgaattttgtttttttagaagaaagtygggttggtgtgttygatgaygtagygtttgtagtggygtttgataaagygtagggtttttayggagatttygtagttttggatatttagygtttggaggttaaagtagttggyggttaygatttgtaagttttggtyggtgatgttttygtaggatttgaggttgagtygtttgaggttgaagtagtttag

SEQ ID NO: 15200 - DNA, 216 bp, Artificial Sequence
  Description of Artificial Sequence: Synthetic polynucleotide
tgggagtgattygattttttagttgygtttattatttttttttttgattyggaaagggaattttttgattttttgygttttttaggtgaggtaatgtttygttttgtttyggttygygtayggtgygygtatttattggtttgygtttattgtttggtattttttagtgagattaattyggtattttagatggaaatgtagaaattattygttttt

SEQ ID NO: 15201 - DNA, 334 bp, Artificial Sequence
  Description of Artificial Sequence: Synthetic polynucleotide
ttgtgttggtaattagygagatttygtygggtaggatttttygagttagatgygggatataatttygtggtgygtygttttttaggtyggttygaaaagygtaatattygggtgggagtgattygattttttaggtgygttygttatttttttttttgattaggaaagggaattttttgatttttggygtttttygagtgaggtattgttttattttgtttyggttygygtayggtgygygtatttattgatttgtgtttattgtttggtattttttagtgagatgaattyggtattttagatggaaatgtagaaattatygttttttatgtta

SEQ ID NO: 15202 - DNA, 201 bp, Artificial Sequence
  Description of Artificial Sequence: Synthetic polynucleotide
ttygatgtaaggyggggtaggtaaaagttyggtagttattygagaaggtgtgattaaaayggaggaattygagagatttttygaggattgtaggttyggygyggagttygygtttaatggtttggtttatggtagygyggaggttattttggttttaaygttyggtgtttttgggtygtattagtaagattttaggatttt

SEQ ID NO: 15203 - DNA, 270 bp, Artificial Sequence
  Description of Artificial Sequence: Synthetic polynucleotide
tttyggttttygttygtgtttttttttttatattttttygtaagttgagggagtyggtttyggttttggttagtttaggaatgggtttttatagtgtagyggygggttgaagggttttttaagygyggttagagtgggtgttaaggtygaggaggygttaagagygagygagggttgtgagggttgttatgtyggtatattgttattttttagaaggaygtagggtagagttttaggttggttttgttatttatgttggagtgtagtggt

SEQ ID NO: 15204 - DNA, 253 bp, Artificial Sequence
  Description of Artificial Sequence: Synthetic polynucleotide
ggtyggaaaagygtagtatttyggtgggagtgattygattttttaggtgygttygttatttttttttttgattyggaaayggaattttttgattttttgygttttttaagtgaggtaatgtttygttttgtttyggttygygtayggtgygygtatttattgatttgygtttattgtttggtattttttagtgagatgaattyggtattttagatggaaatgtagaaattatttgttttttaygtygtttayg

SEQ ID NO: 15205 - DNA, 204 bp, Artificial Sequence
  Description of Artificial Sequence: Synthetic polynucleotide
taaattagtaaatttaatattttaggatttttgttaagaagtttggttttggtygggaggatggagtttagygggtagyggagttgttttagtttttgtygtygtttygttygggagggaggtggggggggttagtttttttgttyggttagtygtttygttygggaggtgaggggygtttttgttyggtygtttttattggga

SEQ ID NO: 15206 - DNA, 228 bp, Artificial Sequence
  Description of Artificial Sequence: Synthetic polynucleotide
attygggaagtataaggggttagggagtttttttttttggttaaggaaaggggtgatagatagtaygtggaaaattaggttttttttattygaatattgygttttttttaygggtttaaaaatyggygtattaggagattatatttygtatttggttyggagggttttaygtttayggagtttygtygattgttagtatagtagtttgagattaaattgtaaggtagt

SEQ ID NO: 15207 - DNA, 217 bp, Artificial Sequence
  Description of Artificial Sequence: Synthetic polynucleotide
tttagtggtygtaggggttgtygtgtgttttgtagatggataygygttatttaatatagagatgygttgagttygggtgattagtgaatygtaygttatygtagatattagaaagygaaagtataygggggaaggtttygggtatagatttagtayggttattattygagttggagttgtttgygagaygatgagygtttgtaatttgtattttgyg

SEQ ID NO: 15208 - DNA, 201 bp, Artificial Sequence
  Description of Artificial Sequence: Synthetic polynucleotide
ttyggtgtttaatttttgaattttaaggaaaaatagggtagaatagaaagtgaaataggttygaaggtatttatygtgtggtaatattttagaygagttygatggtatttatygtgtggtaatattttagaygaatatttaagatgtgttyggagttggttttttttagtgggtttgtggttttagtgattttaagaatga

SEQ ID NO: 15209 - DNA, 204 bp, Artificial Sequence
  Description of Artificial Sequence: Synthetic polynucleotide
ayggtgygtatatttattgatttgtgtttattgtttggtattttttagtgagatgaattyggtattttygatggaaatgtagaaattatttatttttygygtygtttaygttgggagttgtagatyggagttgtttttatttggttattttggtttttttttggtattttttttattttttatttaggattagtttgttgtttt

SEQ ID NO: 15210 - DNA, 223 bp, Artificial Sequence
  Description of Artificial Sequence: Synthetic polynucleotide
tagaagtataagtaatygtttttttttgtattttagtggaaygtygtgggttttttgaagatttttttttgttttgtaggtttyggtattttaagtaygygagtttgygtaggaggygtttygtttttyggagttttttattgttttttagatatagtttyggttttttatttygggyggaggtttttttagaygggtttygattgtttttgtatgtttattg

SEQ ID NO: 15211 - DNA, 201 bp, Artificial Sequence
  Description of Artificial Sequence: Synthetic polynucleotide
tatttataaggttgaggtaggagaattgtttgaagtygggaggyggaggttgtaatgagtygagattatattattgtattttagtttgggygataagagygaaattttgtaataatattaataataataataaaataaaaataaaaataaaaaagaaaataagagaygyggtggttttgtttgtaattttagtattttggg

SEQ ID NO: 15212 - DNA, 203 bp, Artificial Sequence
  Description of Artificial Sequence: Synthetic polynucleotide
tttaatattaagttaggtttagggaagtgttttttttttttttttttttttttatttgagaygtagttttattttgttatttaggttggagtatagtggygygatttyggtttattgtaagtttygtttttygggtttaygttattttgttgttttagtttttygagtagttgggattatygttygattaatttatttgtatt

SEQ ID NO: 15213 - DNA, 201 bp, Artificial Sequence
  Description of Artificial Sequence: Synthetic polynucleotide
tataaaaagaattataaaatattgttgaaaaaaattagataatagtygggygyggtgttttatgtttgtaattttagtagtttgggaggtygagttgggyggattaygaggttaggagatttagattatttyggttaatayggtgaaatttyggtgaaatttygtttttattaataatataaaaaaattagtygggygtgg

SEQ ID NO: 15214 - DNA, 201 bp, Artificial Sequence
  Description of Artificial Sequence: Synthetic polynucleotide
attattgttaaaaattaaattgggtygggygyggtggtttaygtttgtaattttagtattttggggggtygaggttggyggattaygaggttaggagatygagattattttggttaatayggtgaaattttatttttattaaaaatataaaaaattagtygggygaggtggtaggtatttgtagttttagttattygggag

SEQ ID NO: 15215 - DNA, 201 bp, Artificial Sequence
  Description of Artificial Sequence: Synthetic polynucleotide
tttgttttgattttgtttgtgggtgtygggatatttgggtgtagagggtttgtgtttagttagaagygatttttgtttttttttgygtaggygttggtgygttygtygygtgtgygtggttygtgtgtygttgtttyggtttgygtttttatatgtgtaggaaaggataygtygtttgtttttaygttttttgtgattttt

SEQ ID NO: 15216 - DNA, 201 bp, Artificial Sequence
  Description of Artificial Sequence: Synthetic polynucleotide
gaggttgaggtaggagaattatgtgaattyggaaggyggagtttgtagtgagtygagatygygttattgtattttagtttgggygatagagygagatttygttttaaaaaaaaaaaaaaaaaaaaaaaaagtgatttgggtygggygyggtggtttaygtttgtaattttagtattttgggaggtygaggagggtagatta

SEQ ID NO: 15217 - DNA, 201 bp, Artificial Sequence
  Description of Artificial Sequence: Synthetic polynucleotide
tattagttaggtatggtagtatatgtttgtaattttagttattygggaggttgaggtaggagaatygtttgaattygggaggtggagattgtagtaagtygagttygtgttattttattttagtttgggtaagagygaaattttattgggaaaaaaaaatttatagtttaggtygggygyggtggtttaygtttgtaattt

SEQ ID NO: 15218 - DNA, 201 bp, Artificial Sequence
  Description of Artificial Sequence: Synthetic polynucleotide
ggttagtttttygttyggttagtygttttattygggaggtgaggggygtttttgttyggtygtttttattgggaagtgaggagtttttttgttyggttaygatttygtttgggaggtgtgtttagtagtttattggggatgggttatgatgataatggyggttttgtggaatagaaaggygggaagggtggggaaaaaatt

SEQ ID NO: 15219 - DNA, 201 bp, Artificial Sequence
  Description of Artificial Sequence: Synthetic polynucleotide
attggttaaagagtattgtgggttttyggaagtatttgtttttttattagttgtaaatyggaatgataattagtttttaggttttggtttttgaatgtaygttgygaaygatgtattgttttggttttatggtaggggttggggaggttygttttattttgtatttygattygggtttaaagttgagtttgaagggttttt

SEQ ID NO: 15220 - DNA, 201 bp, Artificial Sequence
  Description of Artificial Sequence: Synthetic polynucleotide
ttygttattaygttyggttaattttttgtatttttagtagagayggggttttatygttttagttgggatggtttygattttttgatttygtgatttgttygtttyggttttttaaagtgttgggattataggygtgagttatygtattyggttttttttttttttttttttttttaagatagagttttattttgttgttta

SEQ ID NO: 15221 - DNA, 201 bp, Artificial Sequence
  Description of Artificial Sequence: Synthetic polynucleotide
atttyggaaagtataggaggttatgttttagtgtggttttttttttttgggtttaagttaaggtttttatygtgtttgtyggtttttygggtttttgygyggtggattttggatttttttgtttygttttgttttagggtttttgtatttgttgttatygyggtttggaaygttttttttttgaaattttgtgatttttat

SEQ ID NO: 15222 - DNA, 201 bp, Artificial Sequence
  Description of Artificial Sequence: Synthetic polynucleotide
tgtgtttataagaatattagttattggatttagggtttatttaatttagtatgattttattttaatttgattatatttgaaaagatttttggtygggygyggtggtttatgtttataattttattattttgggaggtygaggtaggtggattatttgaggttaggagttygagattagtttggttaatatggggaaatttt

SEQ ID NO: 15223 - DNA, 211 bp, Artificial Sequence
  Description of Artificial Sequence: Synthetic polynucleotide
tttagtttttaggaygtgttttttatggttttttttgyggtgtggttaygttyggatttttttggtattttttatttgtttygtaygatttgttttgygygatttgtttygtaaggtyggggggagygtttttttttttygygattttttattttttttyggtattygtttatttygttgtttaggttttttgttttttyggttttagggc

SEQ ID NO: 15224 - DNA, 201 bp, Artificial Sequence
  Description of Artificial Sequence: Synthetic polynucleotide
gtgygygtatttattgatttgygtttattgtttggtattttttagtgagatgaatygggtattttagatgtaaatgtagaaattattygttttttttgtygtttaygttgggagttgtagatyggagttgtttttattyggttattttggttttttttttygaaaagagtattttttaattaagaagatggttttggttgt

SEQ ID NO: 15225 - DNA, 201 bp, Artificial Sequence
  Description of Artificial Sequence: Synthetic polynucleotide
atttagtggattttatatyggggttgtaggtggagttgtttgttagttttgygtygtgtgtttatattttttagtttttgggtggtygatgggattgggygtygtggagtagggggtggtattygttygggaggtttgggyggtataggagtttatggagtgggtgggaggtttaggtatggtgggttgtaggttttgagt

SEQ ID NO: 15226 - DNA, 201 bp, Artificial Sequence
  Description of Artificial Sequence: Synthetic polynucleotide
gatatgtataggttatttaagagaatgatygatttttggttattyggtgtttgtttgttgyggtggygttgtgtygggtttaggggttttagggattttygtygtgttgttagttttggaattttagtggggatttgttgtgtggaaattttyggataatagttttttttatggagaatttaygtttttataatgttatta

SEQ ID NO: 15227 - DNA, 201 bp, Artificial Sequence
  Description of Artificial Sequence: Synthetic polynucleotide
ttatttttttatatttgtagagygttttattttttgtaaygtttatttgygaaattgttgygttaggttaggagtattttaagagygagaggtagaygtygtttgattttttattttgataggggatttttttatttggtagtgttaatattyggtttttaygtattttttatggaggattattaggttagtttatgggag

SEQ ID NO: 15228 - DNA, 201 bp, Artificial Sequence
  Description of Artificial Sequence: Synthetic polynucleotide
ttttggtagagttagtattygattttttttgttyggagatttaggygayggtgtygtgtgatttttgatttygyggatgaggaaggtagagagagagygygtagatayggaggtyggygttgaggttgagggagttatattyggtygtaagtttgagggagggaagtygggtgyggaaatagtttagygggtttagaagtc

SEQ ID NO: 15229 - DNA, 201 bp, Artificial Sequence
  Description of Artificial Sequence: Synthetic polynucleotide
tygttgttaygtttagttaattttttgtattgtttagtagagayggggttttatygtgttagttaggatggtttygattttttgattttgtgatttgttygtttyggttttttaaagtgttgggattataggtatgaattatygtattyggttaatttagtggttttgaggaggattygttaggagttttgtaaaatgttt

SEQ ID NO: 15230 - DNA, 201 bp, Artificial Sequence
  Description of Artificial Sequence: Synthetic polynucleotide
atyggatggaygtttgttgttgttttatyggggtygtgtggggagtygagtgygaggtttgttyggatttygagtttttggagttygttagtttgtgttygygggggttgggtttygttagtygggattttttgtttggtygattattttataaaggtgyggttggggaaggggttaggtttttggaaggatggggagggg

SEQ ID NO: 15231 - DNA, 201 bp, Artificial Sequence
  Description of Artificial Sequence: Synthetic polynucleotide
ttataggtgtgagttattyggtttttttttttttttttttttttttttgagaygaagttttatttttgttttttaggttggagtgtaaaggygtaatttyggtttattataatttttatttttygggtttaggtaatttttttgttttaatttttggagtagttgggattataggtgtttgttattaggtttggttaattt

SEQ ID NO: 15232 - DNA, 201 bp, Artificial Sequence
  Description of Artificial Sequence: Synthetic polynucleotide
attattyggtttagtaggtagaggygtaggaatatggggatggatagtagtaygtttaygtyggtttyggttatygagggygygtaygtgaaggttagtygygtygtttaygtgaagyggtagtggtygggtatygggtgaatggygtatattgttagttttagygagatgaggaataygygttygtaggttatggygatg

SEQ ID NO: 15233 - DNA, 201 bp, Artificial Sequence
  Description of Artificial Sequence: Synthetic polynucleotide
gtagttttagttattttaaaggtagaggtgagaatygtttgaattyggaaggagtaggttttagtgagttgaggttatgttatttttttttagtttgggygatagagaaagattttgtttagaaaaagtaaattatgggagtyggygtyggygagygtygttygggaggtagyggttggaggagyggaygggtttygyggg

SEQ ID NO: 15234 - DNA, 201 bp, Artificial Sequence
  Description of Artificial Sequence: Synthetic polynucleotide
gaggttgaggtaggagaatggygtgaattygggaggyggagtttgtagtgagtygagatttygttattgtattttagtttgggygatagagygagatttygttttaaaaaaaaaataaaaataaaaataaaataaaataaaaaatgagttgggtatgatggtataagtttgtggttttagttatttaggaggttgaggtgg

SEQ ID NO: 15235 - DNA, 201 bp, Artificial Sequence
  Description of Artificial Sequence: Synthetic polynucleotide
gtagtttaataattttgygttgtaaatttaaatattttatatattattagatattaaaaataaagatttatgttgttygtttttayggagtgaggatttygttgattttatattyggttatgaatttgtttgaggtttattagttgaaygttttyggttaagaaagttygtygagtgggggyggtttttaaattattattt

SEQ ID NO: 15236 - DNA, 201 bp, Artificial Sequence
  Description of Artificial Sequence: Synthetic polynucleotide
gtgtattttggtttattataatttttattatattygttttttttaggtttaagtgatttttttattttagtttttttagtagttgggattataggtgtayggtattatgatyggttaatttttgtattttttgtagagatgggattttgttatgttatttaggttggtttygaatttttaagttaaagtaattygtttgtt

SEQ ID NO: 15237 - DNA, 201 bp, Artificial Sequence
  Description of Artificial Sequence: Synthetic polynucleotide
ttttatttttattaaaaatataaaaaattagttaggygtggtggtaygttttgtaattttagttattygggaggttgaggtaggagaattgtttgaaygygggttggggaggttgyggtgagtygagattgtattattgtattttagttygggtgatagtgtaagattttattttaaaaaaaaaaaaaatttgttaattta

SEQ ID NO: 15238 - DNA, 201 bp, Artificial Sequence
  Description of Artificial Sequence: Synthetic polynucleotide
taygtattatttatatgagtttttagtaggtttyggttttaaataggtatatgygtatttttttagttttttattgggattttttygttaagttaygttygatgtttttgtttatagttatgagttgtagtaagatgtttaggttyggtgttagygtgygtagtaygtgtgttagtatygtggaatttttgtygttygagg

SEQ ID NO: 15239 - DNA, 201 bp, Artificial Sequence
  Description of Artificial Sequence: Synthetic polynucleotide
tggtattttggaaggtygaygtgggggtattatttgagattaggggttygagattagttttgygaaygtgatgaaatttygtttttattgaaaatttaaygattagtygggggtggtggtgtatgtttgtaattttagttatttaggaggttgaggtaggagaatygtttgaattyggaaggtggaagttgtaatgagtyg

SEQ ID NO: 15240 - DNA, 201 bp, Artificial Sequence
  Description of Artificial Sequence: Synthetic polynucleotide
ttgaggtgggtygggygyggtggtttaygtttgtaattttaatattttgggaggtygaggggggtggattatttgaggtgggttyggygtggtggtttaygtttgtaattttaatattttgggaggttgagaggggtggattatttgaggtgggtygggygyggtggtttaygtttgtaattttaatattttgggaggtyg

SEQ ID NO: 15241 - DNA, 201 bp, Artificial Sequence
  Description of Artificial Sequence: Synthetic polynucleotide
ggggtttyggttaggggtgggtgaggttggtgtttttttaggttttttttagttataggtagtaggtgttatgggagttttgtyggtatttttttttttygttagggttttggtttatttgatggygtagtttttttttaaggtgtgtatyggygtagatattgtgtaggaagttaggttgatgtagayggtttttaagtc

SEQ ID NO: 15242 - DNA, 201 bp, Artificial Sequence
  Description of Artificial Sequence: Synthetic polynucleotide
aaagttgtttaaagttttataatgagttgatttatygggaataggaggaggtttygtygttagtttttgtgttatatttggtatttygtttaggtttatyggagaggagattataygttttttttttagtttttttaatttttttagttaagataggtgttattatttattttagttttagtgtgttttgagtgtgtygga

SEQ ID NO: 15243 - DNA, 201 bp, Artificial Sequence
  Description of Artificial Sequence: Synthetic polynucleotide
tatttttttgttttagtttttygagtagttgggattataggygttygttattgygttyggttaattttttgtatttttttagtagagayggggttttatygtggtttygattttttgatttygtgattygtttatttyggttttttaaagtgttgggattataggygtgagttatygygttyggtygtgtgtgttttttaa

SEQ ID NO: 15244 - DNA, 201 bp, Artificial Sequence
  Description of Artificial Sequence: Synthetic polynucleotide
gtaygtggtagtaggatttatttttggggtgtttygggtyggtgaatttatatttttttaygttaatggttygtagtatttgtagttygtgggtygagtyggttgtggggggtttattggtggtaggggtattattggggagagtggyggayggttgggttggyggyggtggaggtagtaggggttttgttatgtggtygt

SEQ ID NO: 15245 - DNA, 279 bp, Artificial Sequence
  Description of Artificial Sequence: Synthetic polynucleotide
ggtggaagagttgatagtaaggggagtggttaaayggaggyggggtttggaagggggygtggtttgygggtttttgggtygttyggtttttttaggtgtygtagyggaaggtttggagtagaggttgttttttygtttaagtattttttgggtgagtttatatttttggygygagtaygatttttttttttagggaaggtygggtttttygttggggttygattygattttttttttttatttttttttttttgttttatatttagygagtttaggttt

SEQ ID NO: 15246 - DNA, 201 bp, Artificial Sequence
  Description of Artificial Sequence: Synthetic polynucleotide
ttataygggaggttgaggttagagaatggygtgaattygggaggtagagttygtagtgagtygagatggtattattgtattttagtttgggygatagagygagatttagttttaaaaaaaaaaaaaaaaaaaaaggaaaatttaggtttttttttagattgaaatttttgtaaatataatttatgattttatagtagttag

SEQ ID NO: 15247 - DNA, 201 bp, Artificial Sequence
  Description of Artificial Sequence: Synthetic polynucleotide
ttttgttgtaaaagaagtgtttatagaatttttatttttttttattattattattttttgagatagagtygttgtygttygggttggagtatagtggtaygatttyggttaattgtaagtttygtttttygggtttaygttatttttttgttttagttttattttttygtttygtttygtttygtttygtttygttttyga

SEQ ID NO: 15248 - DNA, 201 bp, Artificial Sequence
  Description of Artificial Sequence: Synthetic polynucleotide
gtttttttaatattttgaaatttaaagtgtgatagttttagaggattattaatataagtattatttgaaaatttgttagaaatgaagaattaggtygggygyggtggtttaygtttataattttagtattttgggaggtttagatgggaggattaygatattaggagatygagattattttggttaatayggtgagatttc

SEQ ID NO: 15249 - DNA, 201 bp, Artificial Sequence
  Description of Artificial Sequence: Synthetic polynucleotide
tatggtgaaaatttgttttttttaaaaatataaaaattagttaggygtagtggtatgygtttgtagatttagttatttgggtggttgaggtaggagaatygttggaattygggaggtygaggttgtagtgagtygagatygtattattgtattgtagtttgggtgatagaataagattttaatttaaaaataataataata

SEQ ID NO: 15250 - DNA, 201 bp, Artificial Sequence
  Description of Artificial Sequence: Synthetic polynucleotide
tttgtttaggaaatgtatataggagttggttattttgtgttttgagttttttyggaggtgttggatttttagagagagaaatagagataygtaagagggygaagatgttttagtggtgatatattggggagtttygtttaygattygtttaygatyggtatatttaatttgttttayggaattttattttatagttyggtt

SEQ ID NO: 15251 - DNA, 201 bp, Artificial Sequence
  Description of Artificial Sequence: Synthetic polynucleotide
ygttaggataagygagggtggtttgagttttgtgtttatatggygtatgtygtttagtagatgatattgayggtygtaaaygtygtagggaatatagygygggygtaaatgttaatggtgtttgygtygatgggtttgagtygggtayggatgtttttttggttttttgagygggttgtttttttttttttygtttttttt

SEQ ID NO: 15252 - DNA, 201 bp, Artificial Sequence
  Description of Artificial Sequence: Synthetic polynucleotide
tttttgttgagagtggatttygtgygtgtgttttttaggaayggtgataagtaygayggygattgggttygggatyggygttagggatayggggtgttgygttgygtygayggttttatttataaggtattygggggygygyggtatttgttgtttagagggtataggtttygtggtgggtagggygygtggggtgtatgg

SEQ ID NO: 15253 - DNA, 201 bp, Artificial Sequence
  Description of Artificial Sequence: Synthetic polynucleotide
gatattatattttatatttttttattttttttgattyggagtttygttttgtygtttaggtttgggtgtagtagygygatttyggtttattgtaagtttygtttttygggtttatattatttttttgttttagtttttygagtagttgggattataggtgttygttattaygttyggttaattttttgtatttgtagtaga

SEQ ID NO: 15254 - DNA, 201 bp, Artificial Sequence
  Description of Artificial Sequence: Synthetic polynucleotide
tttttttttagaaagtatatgaataggtygggtayggtggtttaygtttgtaattttagtattttgggaggtygaggygggtggattaygttagaagatygagattattttggttaatayggtgaaatttygtttttattaaaaatataaaaaaaaataagtygggygtggtagtgggygtttgtggttttagttattttg

SEQ ID NO: 15255 - DNA, 201 bp, Artificial Sequence
  Description of Artificial Sequence: Synthetic polynucleotide
gtgtgagagttatatgttaggaataagaggtatgtygagaggtggtygggtayggtggtttaygtttgtaattttagtattttaggaggaygaggtgggyggattataaggttaggagatygagattattttggttaatatggtgaaatttygtttttattaaaaatataaaaaattagtygggygtggtggygggygttt

SEQ ID NO: 15256 - DNA, 203 bp, Artificial Sequence
  Description of Artificial Sequence: Synthetic polynucleotide
ttttataaygttttttattatttgtgagtayggtttgtaaygtggaagatataattttatttgattttttttagatttttttgttgttttagttttttaygygttagttttygggtttttattttaaatttttttaggtttagaatgttttgttttaaattttatygatattatttgygaaattgtagttttttatgattaat

SEQ ID NO: 15257 - DNA, 201 bp, Artificial Sequence
  Description of Artificial Sequence: Synthetic polynucleotide
attatatatggtygggygygatggtttaygttatygagtgattgttgtaattttagtattttgggaggtygagaygggaggattaygaggttaggagatygagattattttggttaatayggtgaaatttygtttttattaaaaaaataaaaatattagtygggygtggtggtgggygtttgtagttttagttatttggga

SEQ ID NO: 15258 - DNA, 201 bp, Artificial Sequence
  Description of Artificial Sequence: Synthetic polynucleotide
agttttagttattygggaggttgaggtaggagaatggygtgaattygggaggyggagtttgtagtgagtygagatygygttattgtattttagtttgggygatagagygagatttygttttaaaaaataaaaataaataataataataattttagatattttataataatttttaggtataagagtttttatgagagtagg

SEQ ID NO: 15259 - DNA, 201 bp, Artificial Sequence
  Description of Artificial Sequence: Synthetic polynucleotide
tgggggttttagaatttttgtagtttatatttttttggtttttttttgggtagtttggaggttttygatttttyggagtttttggtatttgagttttttygtgaaagttygttygagaagggtttttgtttygggtttggtagattggagtttttttttgggttttttttttttttttttgggtgttttgtttttygttaa

SEQ ID NO: 15260 - DNA, 201 bp, Artificial Sequence
  Description of Artificial Sequence: Synthetic polynucleotide
aygygttattaygttyggttaatttttgtatttttagtggagayggggttttattatgttggttaggttggttttaaattttttatttygtgattygttygtttyggttttttaaagtgttgggattataggagtgagttattatgttyggttttaattttagttttatagatgaaaaaayggaagtttaggattagtgat

SEQ ID NO: 15261 - DNA, 201 bp, Artificial Sequence
  Description of Artificial Sequence: Synthetic polynucleotide
aagtagtatttggttttttgtttttgtgttaatttatttyggataatggtttttagttgtatttatgttgttgtaaaggatyggattttgttttttttaygattgtatagtattttatggtatatatatatatatattatatttttttaattyggtttatttatgtttttgttgttgtgaatagttttgtaatgaatatgt

SEQ ID NO: 15262 - DNA, 201 bp, Artificial Sequence
  Description of Artificial Sequence: Synthetic polynucleotide
ttaaataaatgtygggtgttagggtygttgagtaagataataggtygtaaggaygtagtagaggattttyggtygatttgttgygatggagtgagttagyggtgaggtttgaaggtttttgttttatttttttttyggagtagaggtyggggagggtgttgggtgttagtatagagtagagggtyggttayggaattgggg

SEQ ID NO: 15263 - DNA, 201 bp, Artificial Sequence
  Description of Artificial Sequence: Synthetic polynucleotide
gggagtgtagtggygygatttyggtttattgtaattttygtttttygggtttaagygatttttttgttttagtttttttagtaggtaggattatagtygygtgttattatattyggttaattttttgtatttttagtagagattgggttttattatgttagttagaatggttttaatttattgatttygtgattygttygt

SEQ ID NO: 15264 - DNA, 201 bp, Artificial Sequence
  Description of Artificial Sequence: Synthetic polynucleotide
ttagtagaaatagggttttattatgttggttagaatggttttgattttttgattttgtgatttgttygtttygtttttttaaagygttgggattataggygtgagttattgygttttgtttattgtttatttttttttgttygttttattttgattgtyggggttttggatattatataaagagttagttggagagtgaga

SEQ ID NO: 15265 - DNA, 201 bp, Artificial Sequence
  Description of Artificial Sequence: Synthetic polynucleotide
ggaatgtagtggygttatttygttgattgtatttttygtttttyggttgtaagtgatttttttgttttagtttttttagtagttgggattataggygtgygttataatatttagttaatttttgtatttttagtagagaygggtttttattaagttggttaggttggtttygaatttttgatttygtgattygtttgtttt

SEQ ID NO: 15266 - DNA, 201 bp, Artificial Sequence
  Description of Artificial Sequence: Synthetic polynucleotide
tatttyggttttttaaagtgttggtgttataggtgtgaattatygtattyggtttgttttttattttattatttatttattttttttgagattgagtttygtttttgttgtttaggttggagtgtgtagtggtttaatttyggtttattgtaaatttygtttttygggtttaagygatttttttgttttagttttttgagt

SEQ ID NO: 15267 - DNA, 3238 bp, Artificial Sequence
  Description of Artificial Sequence: Synthetic polynucleotide
ttttttttyggattggtttaatttttttttttaagtttggtattttgtttttttttagygggggatattttgtygttttggggtgttygtygtgggygtygtaygattttgggtgtaagttagagattttataaataygtygggttttgygtagyggttttygggaaggtattgttattygtgggagggttyggttygttattttttattttttgttgttttaaygttattttttaagtttggygtttttttttttttttttggaggttttygtgttgttttggggtgttttttgtgggygagatatataatttgggtgtaagttagggatttygygattatttttggttyggygtaggggtggttatttttgggaygatattatttygttatttttttttttggattgtttttattattttttttaattttggygttttgtattttttttttagtggtttttttgtygttttgtggtgtttttygtgggtgagataygtattyggggtgtaagatagggattttaggaygttttygggtttattgtagaggttgttgggaaggtagtgtygttygtgagaggattttagtattttygtttttttttttyggggttgttttaatttttttttttaagattgaygtgttgtttttttttttygggaatttttttgttgttttgtggtgttygtygtgggtaagatatttattttgggtgtaagttagggaattaataattttygtatgttyggtaaaggggttgtyggtaaggtattgttattygtgggattattttagtttygttgtttttttttttaggttatttaaaygtttttatttaagtttggygttttgttgttttttygygggggattttttgttattttggggtgtttttygtgggygagataygtatattgtgtgtaagatagggatttygygattttttygggattggtataggggttgtagggaaggtattgttattygtgaaaggattttagtttygttttttttttttttgggttgttttaaygtttttttttaagtttggtattttgttttttttttttyggggtttttttgttgttttggggtgttattygtgggygaggtaygtattttgggtgtaaattagggattttaagatttttagggttaggygtaggggatgtygggaagttattgtttttygtggaaagtttttttttggattgttttaaagtttttttttaagtttggtattttgtttttttttttyggagttttttttgtagttttygygtgtatatttaggygagataygtattttgttgtaagatagggattttaaattttttygtttgggttaggtttaggggttgtygggaaggtattgtggtttgtgggaygattatagtttagtygttgtttttttttggttggtttaaygtttttttttaagtttgatatgttgtttttttttttygggggttttgttgttatttttaygtgtatttygtgagtaagataggtattttgggtttaagttaggggttttatygtttatttgggttttatttagaggttgtygggaaggtattgtttttagtggaaatttttttttyggattgttttaaygtttttttttaagttyggygttttgtttttttttattyggggattttttatygtattgyggtgtttatygtgggtaygataygtatttygggtgtaagttagggattttataattattttaggttygatgtaggggttatyggataagatattgttgtttttgggatgatatyggtttgttttaattttattttttaattttggagttttgtattttttttttgggggtttttttgttgttttgtggtgttattygtgggygagatatataatttgggagtaagttagagattttaygatatttttgggtttattgtagaggttgttaggaaggyggtgttattygtgggaggattttagttttattatttttatttyggggtygttttaattttttttttaagtttgaygtgtttttttttttttygggaatttatttgtygttttggggtgtttttttgagygagataygtattttgggtgtaagttayggattttaggattattttggtttagygaaggggttgttaggaaggtattgtygtttgtgggagaaatttagygtygtygtttttttttaygggttattttaaagtttttttttaagtttgaggtgttgttttttttttttaggggtttatttgtygttttggggtgttttttatgggygaaataygtattttgggtgtaagatagggattttaygattttttygggtttagygtagggattgttaggaaggtattgttattygtaggaggaattygattagtygtttttttttttgtgttgttttagtatttttattaaagtttggttttttgtggygttygttyggyggtttttttgttattttggggtgtttttatgggtgygattygtattttyggtgtaagttagggattttaygattatttygggtttgaygtaggggttgttgggaaggtattgtygtttatgggaygattttagtttgttaygttttttttyggattgttttaattattttttttaattttggygttttatatttttttttyggtggtttttttgtygttttgtggtgtttttygagggygagataygtattttgggtgtaagttaaggattttatgaygtttttaggtttattatagatgttgtygggaagatagtgttattygtggtaggattttagtattttttttttattttyggggttgttttaaygtttttttttaagtttgaygtgttgttttttttttttgggaatttatttgtygttttggggtgtttttygtggaattttgggtgtaagtttgggatataataattttttygggtttggtaaaggggttgtygggaaggtatygtggttygtgggaagtttttttttggattgttttaaagtttttttttaagtttggygttttgttttttttttagggggtatttttgtygttttggggtgttttttygtgggygygataygtattttgggtttaagttaggaattttaygataatttygagtttggygtaggggttgtygggaaggtattgtygttygtgtgaygatygttgtttgttgttttttttttygtgttgttttaaygttattttttaygtttggygtttta

SEQ ID NO: 15268 - DNA, 201 bp, Artificial Sequence
  Description of Artificial Sequence: Synthetic polynucleotide
tgttatttygttyggttaattttgtgtgtgtgtgtttttagtagagayggggttttatygtgttagttaggatggtttygattttttgatttygtgattygtttttttyggttttttaaagtgttgggattataggygtgagttatygygttyggttttttgtatattattttttgagatattttgaggtaatagttttgg

SEQ ID NO: 15269 - DNA, 201 bp, Artificial Sequence
  Description of Artificial Sequence: Synthetic polynucleotide
ygaygtttaagtattygagaayggtgattaattattttggagagtatttgtaaaggyggttttttagtygtttttttyggaagtygtagtttttgtgttygttttygtattttgtatatttgttgaggtggggygtgttaattattaaattattaatgagtgatggtttaaattgtaggtagagtaatgaatagatggtgg

SEQ ID NO: 15270 - DNA, 201 bp, Artificial Sequence
  Description of Artificial Sequence: Synthetic polynucleotide
tgtaataagttygggggttgattttgggygtgtygggggygagggggttayggtggagayggataygggygtggggyggtygagatttgtayggtttagygggtatyggtattgyggggttttygtttttagaggattattgttttatattgaagtttttttttttgtatatttagagtttgatgtatttttaattatygt

SEQ ID NO: 15271 - DNA, 201 bp, Artificial Sequence
  Description of Artificial Sequence: Synthetic polynucleotide
gggygtggtggygggtatttgtaattttagttattygggaggttgaggtaggagaatggtgtgaattygggaggtggagtttgtagtgagtygagatygygttattgtattttagtttgggygatagagygagatttygttttaaaaaaaaaaaaaaaaaaaaagaagaagttagagtaaggaggtagaatgatttttagg

SEQ ID NO: 15272 - DNA, 201 bp, Artificial Sequence
  Description of Artificial Sequence: Synthetic polynucleotide
ggttagggygtaygyggygttggggttyggggggatgttygttgtttyggtygtattttggttaygtatatttttgggggyggttgttttattgtagggygygggggyggagttyggtttaagaagagyggtaaagggygggyggttttggyggtttagtttagggttygggagtgtttgggggttttttygtttyggggg

SEQ ID NO: 15273 - DNA, 201 bp, Artificial Sequence
  Description of Artificial Sequence: Synthetic polynucleotide
aaaaagtaaaaaataaaaattagtyggttatagtggtgggtgtttgtaattttaattgttygggaggttgagttaggataatagtttgattttgyggggyggaggttgttatgagttaaaatygtgttattttattttaggttgggygtaagagygagattttgttttaaaaaaaaaaaaaaagttttatgtygggygtyg

SEQ ID NO: 15274 - DNA, 201 bp, Artificial Sequence
  Description of Artificial Sequence: Synthetic polynucleotide
taggygtgagttatygygttyggttatttttgataattttattttaaatagtgataggttaaaagttaagagyggatgttttagtatttagttttttagygttttgttagttattttaagtttgtygataggagtttgattttattgattttttttttttttagagttatgtttattttttaaaattttaagaagttgttt

SEQ ID NO: 15275 - DNA, 201 bp, Artificial Sequence
  Description of Artificial Sequence: Synthetic polynucleotide
atttyggaggttgaggtaggagaatggygtgaaygygggaggtggagtttgtagtgagtygagatygygttttttgattttaggtgatttgtttgttttygtattyggttaatttgtttttgtatatataatttttttattgtttaatatattttagggttttttaattttatattttatattttagtttttttaatagat

SEQ ID NO: 15276 - DNA, 201 bp, Artificial Sequence
  Description of Artificial Sequence: Synthetic polynucleotide
tagggtttygttgtgttggtygggtyggtttttagtttttaatygygagtgattygttaatttyggtttttygaggtgtygggattgtagayggagtttygtttatttagtgtttaatggtgtttaggttggagtgtagtggygtgatttyggtttattataatttatattttttagtygtttgttttggttttttaaaat

SEQ ID NO: 15277 - DNA, 201 bp, Artificial Sequence
  Description of Artificial Sequence: Synthetic polynucleotide
aggtygaggtaggyggattataaggttagaatatygagattattttgggtagtaygatgaaatttygtttttattaaaaaatataaaaaattagtygggygtggtggtyggygtttgtagtattagttgtttaggaggttgaggtaggagaatggtatgaatttgggaggyggagtttgtagtgagtygagattgygttat

SEQ ID NO: 15278 - DNA, 201 bp, Artificial Sequence
  Description of Artificial Sequence: Synthetic polynucleotide
ggtgggtgggttatgaggttaggatattgagattattttggttaatatggtgaaattttgtttttattaaaaatatagaaaattagttgggtatgttggtgggtatttgtaagttttagttatttgggaggttgaggtaggagaatggtgtgattttgggaggtggagtttgtagtgagttgagattatgttattgtattt

SEQ ID NO: 15279 - DNA, 208 bp, Artificial Sequence
  Description of Artificial Sequence: Synthetic polynucleotide
tttatttatttatttttgagatagagttttgttttgttgtttaggttggagtgtagtggtgtgattttggtttattgtaagttttgttttttgggtttatgttatttggttttagttttttgagtagttgggattataggtgtttgttattatgtttggttaattttttatatttttagtagagatagggttttattatgttagttag

SEQ ID NO: 15280 - DNA, 201 bp, Artificial Sequence
  Description of Artificial Sequence: Synthetic polynucleotide
ttttttttttttttttttttttttttgagatggagtttggttttgttgtttaggttggtgtgtagtggtttattgtattttttgttttttgggtttaagtgatttttttattttagttttttaagtagttggggttaaaggtttgtgttattatgtttggttaattttttgtattttagtagagatggggttttattgtgt

SEQ ID NO: 15281 - DNA, 201 bp, Artificial Sequence
  Description of Artificial Sequence: Synthetic polynucleotide
ttgtggtgtaattttagtttattgtaatttttgttggtagggtttaagtaatttttttgttttagttttttgagtagttgggattataggtatgtattatgatgtttggttaatttttgtatttttagtagagatggggttttattatgttgattaggttggttttgaatttttgattttaggtgatttgtttattttggt

SEQ ID NO: 15282 - DNA, 201 bp, Artificial Sequence
  Description of Artificial Sequence: Synthetic polynucleotide
gtgggttttaaatattttataagttagagtaattagaatagtatggtattggtataaagataggtatatagtttgtttggttttgttttgttttgttgttgtgtttgttagttatgagttttatgtagttaaataaaggtttttttgtggatttttggttgaggttaagaattggtttttgtttaaatatgatttttagaa

SEQ ID NO: 15283 - DNA, 201 bp, Artificial Sequence
  Description of Artificial Sequence: Synthetic polynucleotide
tattgatttggaagaatggaatgatagttagtgaggtatatttagtaattgagtatggttagtgttggtttttggtttttgagatattgatttatgtagtgttaggatttggggattttttaggtgtaaattagaggttaaatagtttgtttggttaatgggttagaatttgtggttgaatagaggttttgttgtggtttt

SEQ ID NO: 15284 - DNA, 201 bp, Artificial Sequence
  Description of Artificial Sequence: Synthetic polynucleotide
ttatttttgggggatgagaggagggatggtgagaggatatttttaaagaatatttggggttggggaagaattttttatgattttgttttataatttggttgtttattttgtattttgttgtatgttgtttggtttttggttatgttatgtgaatttttggagttattttttttttttttttatttggatggagagggtttt

SEQ ID NO: 15285 - DNA, 201 bp, Artificial Sequence
  Description of Artificial Sequence: Synthetic polynucleotide
tttaatagatatgaaaattgaaggttgggtgtagtggtttaagtttgtaattttagtattttgggaggttgaggtgggtggattatgaggttaggagattgagattattttggttaatatagtgaaattttgtttttattaaaaatattaaaaattagttgggtgtggtggtgggtgtttgtagttttagttatttgggag

SEQ ID NO: 15286 - DNA, 201 bp, Artificial Sequence
  Description of Artificial Sequence: Synthetic polynucleotide
ttgaatagttgggattataggtgtttgttattgtgtttggtttattttttgtgtgtttttagtagagatggggttttattgtgttagttaggatggttttgattttttgattttgtgatttgtttgttttggttttttaaagtgttgggattataggtttgagttattgtgtttggttaaaataattaatttttgtgttaa

SEQ ID NO: 15287 - DNA, 201 bp, Artificial Sequence
  Description of Artificial Sequence: Synthetic polynucleotide
atggatttttgtggtgagtgttatagtttttaaaggtggtgtgtttggagtttgttttttttgatgtttggatgtgtttggagttttttttggtgggtttgtggttttgttggtttaggagtgaatttgtagatttttgtggtgagtgttatagtttataaaggtagtgtggatttatagagtgaatagtagtaagattta

SEQ ID NO: 15288 - DNA, 201 bp, Artificial Sequence
  Description of Artificial Sequence: Synthetic polynucleotide
tattaaaaataaagaaggaggttgggtgtggtggtttatgtttgtaattttagtattttgggaggttgaggtgggtggtggattatgaggttaggagattgagattatggtgaaattttgtttttattaaaaatataaaaaattagttgggtgtggtggtgggtgtttgtagttttagttattgggaaggttgaggtagga

SEQ ID NO: 15289 - DNA, 201 bp, Artificial Sequence
  Description of Artificial Sequence: Synthetic polynucleotide
gttaagatagtgttattgtattttagtttgggaatagagtgagattttgttttaaaaaaaaattattgatatatataaatatttgtgaaattggttgggtgtggtggtttatgtttgtaattttagtattttggggggttgaggtgggtgtattataaggttaggagattgagattattttggttaatatggtgaaatttt

SEQ ID NO: 15290 - DNA, 235 bp, Artificial Sequence
  Description of Artificial Sequence: Synthetic polynucleotide
gtttatagtttttagagagagtgatgtagaagatgggtgatttttgtatttttatttgaggtattgggtttattttattagggagtgttagatagtgggtgtaggttagtgggtgtgtgtattttgtgtgagttgaagtagggtgaggtattgttttattttggaagtataaggggttagggagtttttttttttagttaaagaaaggggtgatagatggtatttggaaaattgg

SEQ ID NO: 15291 - DNA, 201 bp, Artificial Sequence
  Description of Artificial Sequence: Synthetic polynucleotide
ttttgagtagttggtgttataggtgtttattattatgtttggttaattttttgtatttttagtagagatagggttttattatgttagttaggatggttttgattttttgattttgtgatttgtttgttttggttttttaaagtgttgggattataggtatgagttattgtggttggttttaattatgtatttttatttatt

SEQ ID NO: 15292 - DNA, 201 bp, Artificial Sequence
  Description of Artificial Sequence: Synthetic polynucleotide
ttgattatttaggtgtgtttgttatttttttttttgatttggaaagggaattttttgtttttttgtgttttttaagtgaggtaatgttttgttttgttttggtttgtgtatggtgtatgtatttattgatttgtgtttattgtttggtattttttagtgagatgaatttggtattttagatggaaatgtagaaattatttg

SEQ ID NO: 15293 - DNA, 201 bp, Artificial Sequence
  Description of Artificial Sequence: Synthetic polynucleotide
tgggttgttgggtgtttgggttgtttttttattgtttaggataaattttattttgttttattggttgatggtttgttggggagtttgtgggtgagttggtgtttgtaggtgtgtttttttgttgatatgttttttgtgattagttgtttttgtttttttttattgatgtgttttttttgttttttagtagtttttgttttt

SEQ ID NO: 15294 - DNA, 201 bp, Artificial Sequence
  Description of Artificial Sequence: Synthetic polynucleotide
tatttggtttggagggttttatgtttattgagttttgttgattgttagtatagtagtttgagattaaattgtaaggtagtagtgaggttgggggaggggtgtttgttattgtttaggtttgtttaggtaaataaagtagttgggaagtttgaattgggtggagtttattatagtttaaggaggtttgtttgtttttgtagg

SEQ ID NO: 15295 - DNA, 201 bp, Artificial Sequence
  Description of Artificial Sequence: Synthetic polynucleotide
ttgttttgtagtttgattttagattgttgtgttagtaattagtgagattttgtgggtgtaggattttttgagttaggtgttggatataatttttaggtgtgttgttttttaagtttgttggaaaagtgtagtattttggtgggagtgatttgattttttaggtgttttttgttatttttttttttgattaggaaagggaat

SEQ ID NO: 15296 - DNA, 201 bp, Artificial Sequence
  Description of Artificial Sequence: Synthetic polynucleotide
agtgatgtagaagatgggtgatttttgtatttttatttgaggtattgggtttattttattaagggagtgttagatagtgggtgtaggttagtgggtgtgtgtattgtgtgtgagttgaagtagggtgaggtattgttttatttgggaagtataaggggttagggagttttttttttgagttaaagaaaggggtgatggatg

SEQ ID NO: 15297 - DNA, 201 bp, Artificial Sequence
  Description of Artificial Sequence: Synthetic polynucleotide
tattaggatattttggttgtagagaggagttatttattgtgagttttttttgagttgttttattatttagtaaagtttttttttattttgtttattttttgtttgtttatgtatgttattgtttttgggtgttgaatttgttaaatggtggaggtgaaagagttttaatataaatagagttgaaatatgttttttgtttgt

SEQ ID NO: 15298 - DNA, 201 bp, Artificial Sequence
  Description of Artificial Sequence: Synthetic polynucleotide
gttggagtgtaatggtatgattttggtttattgtaatatttgttttttgggatttagtaatttttttgttttagttttttgagtagttgagattataggtgattattattatgtttggttgatatttgtatttttagtagagatggggttttattatgttggttaggttggttttgaatttttgattttaggtgatttgtt

SEQ ID NO: 15299 - DNA, 201 bp, Artificial Sequence
  Description of Artificial Sequence: Synthetic polynucleotide
tattgttggtattagtatttggaagaggggaatattgtggtttttgaaaatttggagttgttagtaattgaggagttttaaggagtgagatgggggtgttgttttattatttttttatttttgtagttggtagttttgttagtggtgggggttgggttgaggggtggtggtatattaggggggtggtggtatatattatag

SEQ ID NO: 15300 - DNA, 201 bp, Artificial Sequence
  Description of Artificial Sequence: Synthetic polynucleotide
gttttttggtattattagtatttgggttttttggagtggaagtggttggttggggatatgtagtttatagaggtttagatgaaaatttggttttaaaattgttagatgaaatatgaatggtaaatgtaggatttatagttgaatagtttttttttggggtttttttatgtgtttgggttttttatttattgttttttggtt

SEQ ID NO: 15301 - DNA, 207 bp, Artificial Sequence
  Description of Artificial Sequence: Synthetic polynucleotide
attagagtagaggggtttttttattttttgtttagttttttgatttggttttttattttttaggaaatatattttggtttgaggtttatttgttgttgttgttgttggaggagttggttttgaatgagttggtgatgttgatgtgtttggtatgtggttttagttttaaggatgtgttggtttgttggttgtaggggttataggagt

SEQ ID NO: 15302 - DNA, 201 bp, Artificial Sequence
  Description of Artificial Sequence: Synthetic polynucleotide
atattaggggaagaagatataagtgttggttatttataggagtattttagtagaaggatatgttgataggtatttggaagttagtaggttgtggattagtgggaggaggtggaggttggtttgggtagttaggggagagttggggttgttgagtattttaattttaggggaaaattattttttttttggttgttttatggg

SEQ ID NO: 15303 - DNA, 201 bp, Artificial Sequence
  Description of Artificial Sequence: Synthetic polynucleotide
ttgattttttaggtgtgtttgttatttttttttttgatttggaaagggaattttttgattttttgtgttttttaagtgaggtagtgttttgttttgttttgtgtatggtgtatgtatttattgatttgtgtttattgtttggtattttttagtgagatgaaattggtattttagatggaaatgtagaaattatttgttttt

SEQ ID NO: 15304 - DNA, 201 bp, Artificial Sequence
  Description of Artificial Sequence: Synthetic polynucleotide
ttatgttttaggtatattgatatttttgtattggttttttttaggaggttatgttttaggtatatgggtatttttatattgattttttttagtaggttatgttttaggtatatgggtatttttatattgattttttttgggaggttatgttttaggtatatgggtatttttatattggttttttttaggaggttatgtttt

SEQ ID NO: 15305 - DNA, 201 bp, Artificial Sequence
  Description of Artificial Sequence: Synthetic polynucleotide
gtttttttgtttggttgtttagtttgggaagtgaggagtgtttttttttggttgttattttgtttaggaagtgaggagtgtttttgtttggttatttattgtttgggatgtggggagtatttttgttaggttgtgattttatttgggaattgaggagtgtttttgttttgttattattttatttgggaggtgaggagtgtt

SEQ ID NO: 15306 - DNA, 201 bp, Artificial Sequence
  Description of Artificial Sequence: Synthetic polynucleotide
gagggagatgtggggtgggaattggggttgtttgtggtaggttagagtaagttttgggtggatatggttttggtgggttttatattttgagtagttggttgttttattagttttgggtagtgaggggtttattatttgggatagtagttgtggagggtgtgttgagttttttagtagtgttagtttgttggtgttgtgttc

SEQ ID NO: 15307 - DNA, 201 bp, Artificial Sequence
  Description of Artificial Sequence: Synthetic polynucleotide
tttgattaaaaataaataaatatggttgggtgtggtggtttaggtttgtaattttagtattttgggaggttgaggtggtggattataatgttaggagattgagattattttggttaatatggtgaaattttatttttattgaaaatataaaaaattagttgggtgtggtggtgggtatttgtagttttagttatttaggag

SEQ ID NO: 15308 - DNA, 201 bp, Artificial Sequence
  Description of Artificial Sequence: Synthetic polynucleotide
tggttagggggtatttttagatgtatagaagttttggaggttatggtaagtttgtaattgggatttgtttttaggtttatatgtgtagttttttagttgtgtaatttttttaaatggagtagttttggtgtgggtggggtttgggttggtagtgggggtggggttggtagtgggggtggggttagttgggggaggaggggg

SEQ ID NO: 15309 - DNA, 201 bp, Artificial Sequence
  Description of Artificial Sequence: Synthetic polynucleotide
tatggtgaaattttatttttattaaaaatataaaaattagttgggtgtggtagtgtatgtttgtaattttagttatttgggaggttgaggtaggattattgtttgaatttggaaggtggaggttgtagtgaattaagagagtggttttgtattatagtttgaatgatagagtaagattttattttaaaataattaattaat

SEQ ID NO: 15310 - DNA, 201 bp, Artificial Sequence
  Description of Artificial Sequence: Synthetic polynucleotide
attatgtttggttaattttttttttttgtatttttagtagagatggggttttattgtgttagttaggatggttttgattttttgattttataatttgtttgttttggttttttaaagtgttgggatgataggtgggagttattgtgtttggtttaatttagtgtttgatatttgaagatgatttgggttagaggagattgt

SEQ ID NO: 15311 - DNA, 201 bp, Artificial Sequence
  Description of Artificial Sequence: Synthetic polynucleotide
agtgagttgttgatgttagtgagatgttaggttggatttagtaagttgttgatgttagttagatgtagagtagagaatgttggttaaagagtagttaggtggtgtttgtttggttgaagtttagttttggagaggtaggttttgtattaggatgtggaggttttggggttatgaaatttttagggtgagagataaaggtag

SEQ ID NO: 15312 - DNA, 380 bp, Artificial Sequence
  Description of Artificial Sequence: Synthetic polynucleotide
tttttttttttttttttagatggagtttagttttgtttttatgttgtagggtagtggtgtggttttggtttattgtaatttttgttttttgggtttttgtgatttttttgttttagttttttgagtagttgggattataggtatatgttattatgtttagttaatttttgtttgtttgtttatttatttattattatttttgagatggagttttgttttgttattaggttggagtgttattggagtgtaatggtatgattttggtttattgtaatttttgttttttgggtttaagtaatttttttgttttagttttttgtgtaattgggattataggtatgtgttattatttttagttaattttttgtattttagtagag

SEQ ID NO: 15313 - DNA, 201 bp, Artificial Sequence
  Description of Artificial Sequence: Synthetic polynucleotide
gagtgtaatggtgtgattttggtttattgtaagttttgttttttgggtttatgttatttttttgttttagttttttaagtagttgggattagaggtgtttgttgttatgtttagttaattttttgtatttttagtagagatggggttttattgtattagttaggatggttttgattttttgattttgtgatttgtttgttt

SEQ ID NO: 15314 - DNA, 201 bp, Artificial Sequence
  Description of Artificial Sequence: Synthetic polynucleotide
tatagggtgttgaaattaagttatttagggagtttgtagattttattttttttggtgagagagtttggtggggagtattttatttaatgtagggaatagtgttattgtggtttttattttttggttttaagtgatttatttgttgtagttttttaagtagttgggattataggtgtgtgttattatgttgggttagttttt

SEQ ID NO: 15315 - DNA, 201 bp, Artificial Sequence
  Description of Artificial Sequence: Synthetic polynucleotide
ttttttttttgggggtttttttatgttttatgtagtttatggtgtggggtttattggttttggtggggtggaaggttttatgttgttgttgttttatgttgttggtggtgggggtttgttgggggttgggaggaaggtaaataggaagggtttattggggagagggtgggggagtatgttatagttgttgtagtttgttgt

SEQ ID NO: 15316 - DNA, 201 bp, Artificial Sequence
  Description of Artificial Sequence: Synthetic polynucleotide
tttaggtgtgtttgttatttttttgatttggaaagggaattttttgattttttgtgttttttaagtgaggtaatgttttattttgttttggtttatgtatggtgtgtgtatttattgatttgtgtttattgtttggtattttttagtgagatgaatttggtattttagatggaaatgtagaaattatttgttttttgtgtc

SEQ ID NO: 15317 - DNA, 201 bp, Artificial Sequence
  Description of Artificial Sequence: Synthetic polynucleotide
ggttgtagtgtagtggtgtgatttttgtttattgtaagtttttttttttgggtttatgttatttttttgttttagtttttgagtagttgagattataggtgtttgttattatatttggttaattttttgtaaaaaatttaaaaaaaaaattaaagataaaatgggtttggtagtatgatattttttatttttaattatttg

SEQ ID NO: 15318 - DNA, 201 bp, Artificial Sequence
  Description of Artificial Sequence: Synthetic polynucleotide
ttttgttttttttaagtgttggttaggttgagaaataaagggatagagtataaaagagggaaattttaaagttgggtatttgggggagatattatatgttggtaggttttgtgatgtttttgagttgtaaaattagtaagtttttattagggatttttaaaaggggagggagtgtatgaatagggtgtgggttatagagat

SEQ ID NO: 15319 - DNA, 201 bp, Artificial Sequence
  Description of Artificial Sequence: Synthetic polynucleotide
agtagtgtttttataaataggtgtgaaaattgagtatgttttgggttggttagttgaattattgtgtgtagagagggagttttggttgtataggtatagtggtggattatgtttttatatatgttgtttgtatagaaaatggagaataagtttttttttgggttgggtttttaagattataataataagagtttgttaaag

SEQ ID NO: 15320 - DNA, 201 bp, Artificial Sequence
  Description of Artificial Sequence: Synthetic polynucleotide
ttttaggggttttaaattggagttttatttttaggatttataaaattttagatatagttaggatttgttagggagattagttttttttggtagtttgggtgttgttgtttttaatatatagtgataatttggaatttatttttagagttatttagaaatatgttttggagatggtgttttttgaaagatttttatttttaa

SEQ ID NO: 15321 - DNA, 201 bp, Artificial Sequence
  Description of Artificial Sequence: Synthetic polynucleotide
ggatgtttggttatatttgattttttatttttgggtatggaggtttgtttgtagaggtttgggtttgggtataaagggagagagaggtttttattgttttgtaggggttgaaatgtagattgtgtatttttggtgattttggggatttttttttgattattaggatttttttggattttagggtttttgttttgtttaggt

SEQ ID NO: 15322 - DNA, 201 bp, Artificial Sequence
  Description of Artificial Sequence: Synthetic polynucleotide
ttagtagagatggggttttattgtgttagttaggatggttttgattttttgattttgtgatttgtttgttttggttttttaaagtgttgggattataggtgtgagttattgtgtttggttatttattttttttaagagatggttgatatgattttaatttttttaaatttttgaagatttgttttgtgatttagtatgtga

SEQ ID NO: 15323 - DNA, 568 bp, Artificial Sequence
  Description of Artificial Sequence: Synthetic polynucleotide
aggtggagttgtttgttagtttggtgttgtgtgtttgtattttttagtttttgggtagttgatgggattgggtgttgtggaataggggttggtgtttgttggggaggtttgggttgtataggagtgtatggtgggggtggaggtttaggtatggagggttgtaggttttgagttttgtttggtggggaggtagttaaggtttagtgagaagttgagtatagtagttgttggtttaggtgttaagttttttattgtttgggttggttggttgttttgagtgtggggtttgttaagtttatgtttatttggaatttgagttggtttgtaagtgtagtttgtagttatggtttttgtttatgtttttttttttatatttatttgtaagttgagggagttggttttagttttgtttagtttagaaaggggtttttatagtgtagtgatgggttgaagggttttttaaatgtggttagagtgggtgttaaggttgaggaggtgttgagagggagtgagggttgtgagggttgttagtatgttgttattttttatttttgtgtttgtatattaa

SEQ ID NO: 15324 - DNA, 201 bp, Artificial Sequence
  Description of Artificial Sequence: Synthetic polynucleotide
ttttttttttttttttttttttttttttttttgagatggatttgtgttttgttgtttaggttggagtgtagtggtgtgatttttgtttattgtaagttttgttttttgggtttatgttatttttttgttttagttttttgagtagttgggattataggtatttattatgatgtttagttaattttttgtatttttagtaga

SEQ ID NO: 15325 - DNA, 201 bp, Artificial Sequence
  Description of Artificial Sequence: Synthetic polynucleotide
attttagagaagtttatgggagttttagggagagttttttttgtgaagggtagggtattttggaatgggtttgttgagtttgtttttatttggaatttatgtttgtttataagtgttttatatagttttggtttttatttgtgtttttttttttatatttttttgtaagtagagggagttaattttggttttggttagttt

SEQ ID NO: 15326 - DNA, 201 bp, Artificial Sequence
  Description of Artificial Sequence: Synthetic polynucleotide
ggataaagaaaatgtggtatatggttgggtatggtggtttatgtttgtaattttggtattttgagaggttaaggtgggtagattatgaggttaggagattgagattattttggttaatatgatgaaattttatttgtattaaaaaatataaaaaattagttaggtatggtggtgggtgtttgtagttttagttatttggga

SEQ ID NO: 15327 - DNA, 201 bp, Artificial Sequence
  Description of Artificial Sequence: Synthetic polynucleotide
ttgtattttagtttgggggatagagtgagattttgttttaaaaaagaaagaaaaaaatgtttttttttttttgttttttttgatttttattttgttttgtgggttttttattaataattgtttgtgtttgatttgggtgttttttttattataattttttttttaggtgtatgtttttataataaagtttattttatggtt

SEQ ID NO: 15328 - DNA, 201 bp, Artificial Sequence
  Description of Artificial Sequence: Synthetic polynucleotide
ttagttttatttatgtgttatttatggataagggtaattattagtagtagtgattatgtgtgttaggtatttgtaggtttttttttgttttttgaattatgtgttatgtttagtttagggatgataaattgaggtgtatgagtaggtgagaagatgaatagtgtatttgggtaaggttgttagtttttttgtgtttttgtg

SEQ ID NO: 15329 - DNA, 201 bp, Artificial Sequence
  Description of Artificial Sequence: Synthetic polynucleotide
ttattattgatatttattttttttttatttatagtatttgtatgtatgttaagaattggattggtaagagtgagtttagtaatgagtttattattatggtggatgaggtaggtatgtgggattgggtggaattttgttttagaggagtttgggagttaatttttgagggtttagatgtttaaatgtagaagtagatttttg

SEQ ID NO: 15330 - DNA, 201 bp, Artificial Sequence
  Description of Artificial Sequence: Synthetic polynucleotide
gtgggaggtgtgtaagtgatatattgaggggtttaggtagtagtttttatatgttgttaggttagagtagttttgggttatgtgggtgtttttagttgttgttgtaggtggaggtatgttggttttttaaggatgtgatagtggttggatttttatgattattgtttggttattagagggtaagttttagggttagttaag

SEQ ID NO: 15331 - DNA, 201 bp, Artificial Sequence
  Description of Artificial Sequence: Synthetic polynucleotide
gggttggttttgggttgtttggggtttttgtgatttttatatttattttttttgtagggtgtggtgttgggttttatggtgggttttatgatttatgggtggtgttaattttagtttttggatatgatgatgtggtgtttgattttgtttttttgtgaggttttggttaagttaattatgttggtggatgttgatgttgag

SEQ ID NO: 15332 - DNA, 201 bp, Artificial Sequence
  Description of Artificial Sequence: Synthetic polynucleotide
taatattgtttgtaaatgattgaattggtttttgatttttttagagaagattgtgtatagatatttggatgattttattagttaggaaattgagtggggtgggatgtatttgtagtagtggttggatagtgtgattatgtaggatggatggtttagatggttatgttgtagtttattagtagtaggtttttaaggtgatta

SEQ ID NO: 15333 - DNA, 201 bp, Artificial Sequence
  Description of Artificial Sequence: Synthetic polynucleotide
ttggatagtaaatatgtgtgggttttttttgtgttggatagtaaatatgtgtgggtttttttgtgttaaatggtaaatatgtgtgggttttttgtgtgttgaatagtaaatatgtgtgggttttttttgtgtttgatagtaaatatgtgtgggttttttgtgtgttggatgataaatatgtatgggtgttttgtgtgttgg

SEQ ID NO: 15334 - DNA, 201 bp, Artificial Sequence
  Description of Artificial Sequence: Synthetic polynucleotide
gttttattatgttggttaggttggtttttttaatttttgattttgtgatttatttattttggttttttaaagtgttgggattataggagtgagttattgtgtttggttgagatttttatgttattattttatgaagtttttggtataatgtttgatatatagtaggtatttgataagtggagtttttattgttgttttttt

SEQ ID NO: 15335 - DNA, 201 bp, Artificial Sequence
  Description of Artificial Sequence: Synthetic polynucleotide
gagttaggtgtgggatatagttttgtggtgtgttgttttttaagtttgttggaaaagtgtagtatttgggtgggagtgatttgattttttaggtgtgtttgttatttttttttttgattaggaatgggaattttttgattttttgtgttttttgagtgaggtaatgttttgttttgttttggtttgtgtatggtgtgtgta

SEQ ID NO: 15336 - DNA, 201 bp, Artificial Sequence
  Description of Artificial Sequence: Synthetic polynucleotide
ttttttggagttaattgtgtttttattattttaaatagagtagttgggattgggtgttgtgttttatgtttataattttagtattttgtgaggttgaggtgggtagattatgaggttaggagattgagattattttggttaatatggtgaaaatttgtttttattaaaaatataaaaaattttttgggtgtggtggtgggc

SEQ ID NO: 15337 - DNA, 201 bp, Artificial Sequence
  Description of Artificial Sequence: Synthetic polynucleotide
ttgatagagtgaaatggtggtggtggttgggatgatgttgttgggtttgttataggtgggtgggtaggtgttgggttaggtgatggaggaggtggtaggtggtaattttttgtttatgttgttgattgtttgtgtttttatttttagtttggtttatttgttttgttttgttgttggttatttggtttagttgattgtagg

SEQ ID NO: 15338 - DNA, 201 bp, Artificial Sequence
  Description of Artificial Sequence: Synthetic polynucleotide
gtgaaattttgtttttattaaaaatattaaaaaaattagttggtgtggtggtaggtgtttgtagttttagttatttgtaaagttgaggtaggagaatggtgtgaatttgggaggtggagtttgtagtgagttgagattgtgtttttgtattttagtttgggtgatagagtgagattttgttttaaaaaaaaagtagtttgg

SEQ ID NO: 15339 - DNA, 201 bp, Artificial Sequence
  Description of Artificial Sequence: Synthetic polynucleotide
tttttatttttgtttttgagatggagttttatttttatttaggttggagtgtagtagtatgatttgggtttattgtaatttttgttttttgggtttagttgatttttttgttttagttttttaagtggttggaattataggtatatattattatatttggtaaatttttttttttttttttttgtatttttagtagattgt

SEQ ID NO: 15340 - DNA, 201 bp, Artificial Sequence
  Description of Artificial Sequence: Synthetic polynucleotide
tatggtgaaattttgattttgttaaaaatataaaaattagttgggtgtggttgtgagtatttgtaattttagttatttgggaggttgaggtaggagaattgttagaatttgggaggtggaggttgtagtgagttaagatggtattattgtattttagtttgggtaatagagtgagattttattttaaaataaaaaaaaata

SEQ ID NO: 15341 - DNA, 201 bp, Artificial Sequence
  Description of Artificial Sequence: Synthetic polynucleotide
atttgttttaaggattggaagaggaaaattaaaaatattatttgaaaggttggatgtggtggtttatatttgtaattttagtattttgggaggttaaggtgggtggattatgaggttaggagtttgagattagtttggttaatataatgaaattttgtttttattaaaaatataaaaattagttgggtttggtggtaggta

SEQ ID NO: 15342 - DNA, 201 bp, Artificial Sequence
  Description of Artificial Sequence: Synthetic polynucleotide
tgtagtggtataatttttgtttttgtaattttttttttttggttttaagtgatttttgtgttttagtttttaagtagttgggattataggtttgagttttgtttggttaattttttttatatttttagtagagatggggttttattatgttggttaggttggttttgaatttttgattttaagtgatttgtttattttggt

SEQ ID NO: 15343 - DNA, 201 bp, Artificial Sequence
  Description of Artificial Sequence: Synthetic polynucleotide
aatatgggtggttttgtgtaggatgggggttttagggttgtttgagttggaggatagtttgtagtttttattgtttgtagttgaagtgtgttgtgagattgttgtaggggtttgggttatttttgttttgggggattttaaaaagttgagttatatttatgttgaaatttttattgaggataattatgtattatatagatt

SEQ ID NO: 15344 - DNA, 201 bp, Artificial Sequence
  Description of Artificial Sequence: Synthetic polynucleotide
agtttttgttgattttagtatgagttgtttatatatatttaaggttggtagtatagtggtatatgtggtaaaattgagtaggtgtggatgggaagggagtgtattagtttgtgtgtgaaggttatatttaggggtggagggaggggagaaatatttttgttgtatttgtagtgttttattttttttagtaatttaaaatgt

SEQ ID NO: 15345 - DNA, 234 bp, Artificial Sequence
  Description of Artificial Sequence: Synthetic polynucleotide
ttttgttgatgtagtgtttgttgttgtttttggatgattttagtggtgaagtggtgtattatgttataggtttgttggaatttttgtttatttgttgagtggtagtaaatgaagttgaggtagtggtgtaagtgatattggtgttggatagatagagtgtttagtttaatgatagtggagatataattatttatttttttgttaaggagaaggggatttatgagtgtagttttt

SEQ ID NO: 15346 - DNA, 201 bp, Artificial Sequence
  Description of Artificial Sequence: Synthetic polynucleotide
tagtttttttatttgtgtagtgggtgtaatgttgatgattgtttttgggaagttagatggtgtttgggaggtgttgagttggggttgatatagagtgagtgttttgtgaagtatttgggttttgtgatgtttttaagtttatagatgtattatgttatgaggaatatatttgggttggtgatgttggagataagggatttt

SEQ ID NO: 15347 - DNA, 201 bp, Artificial Sequence
  Description of Artificial Sequence: Synthetic polynucleotide
tagtgagtatagattgtgttattgtattgtagtttgggtgatagaagtgaaaagaaatattgttttaaaaaaaaaataggagggaggagttaagatggttgaataggaatagttttggtttatagtttttagtgtgagtgatgtagaagatgggtgatttttgtatttttatttgaggtattgggtttattttattaggga

SEQ ID NO: 15348 - DNA, 201 bp, Artificial Sequence
  Description of Artificial Sequence: Synthetic polynucleotide
gatgaaattttgtttttattaaaaatataaaaatttagttgggtgtggtggtggatgtttgtagttttagttatttaggaggttgaggtaggtgaatggtgtgaatttgggaggtggagtttgtagtgagttgagattgtgttattgtattttagtttgggtgatagagtgagattttgttttaaaaataaaataaaatta

SEQ ID NO: 15349 - DNA, 201 bp, Artificial Sequence
  Description of Artificial Sequence: Synthetic polynucleotide
gtgagtgtggggtttagttggttgttttaagtattggtatataggtaggttttaggtagggtttgtagttggattaggtatgttattttgaagggaatgtggtggtattttaagaggggtgtttagattttgaagttttggaaggggtgattttatttgttaattagtttttttagttttgttatttgtagttttagggat

SEQ ID NO: 15350 - DNA, 201 bp, Artificial Sequence
  Description of Artificial Sequence: Synthetic polynucleotide
gtgtggttttttagttagggtagtttgaaatttaggaatgttttaaggttattttgtgggaattgtggtgttagggtttttgaatatttttttgttttttgagttgagttgttttatttgttttttaaatgggttttgggaggaaggtttgtgtgtttttttaaggtgaggagttattgatgtaaattttttgtaaggatt

SEQ ID NO: 15351 - DNA, 201 bp, Artificial Sequence
  Description of Artificial Sequence: Synthetic polynucleotide
ggggatttagtttatgtgtgtgggggttgtgtgtgtttgttttgtttgtttatgtatgttatatatgtgagagtttatagtgagggtagtttttatatgtgatggtttagaggagtgagtattttaggttttttagtatgtttttgtgttgattttttgtagtattgttgggagttatgtgagtgtttatgtttgtgtgtg

SEQ ID NO: 15352 - DNA, 201 bp, Artificial Sequence
  Description of Artificial Sequence: Synthetic polynucleotide
tttatttgttttttgtttttttttttgttggatttgaggtgttgtttttgttgtgttgtttttgtgttatgttatgttatgttatgttatgttatgttatgtttttatgttatgtttatgttatgtttttattttttgtttatagggaaatgggttttggtgatgtgagggtgtttgttgtgtttggtgtttttatagggg

SEQ ID NO: 15353 - DNA, 201 bp, Artificial Sequence
  Description of Artificial Sequence: Synthetic polynucleotide
agtttttaaagttttaatttttttttttttttttttttttttttttttttttttttgagttggagttttattttgttgttaggttggagtgtagtggtgtgattttagtttattgtaatttttgtgttttgggtttaagggatttttttgttttagttttttgagtagttgagattgtaggtatgtgttattatgtttagt

SEQ ID NO: 15354 - DNA, 201 bp, Artificial Sequence
  Description of Artificial Sequence: Synthetic polynucleotide
ttgtaggatagttttaaaaaggaaggttattttttttttgtttattattgtagtttgttaattaattagaaggtaggtgttgagatagtaataattagttgatagttgtggaggattgttgggatttttatagagtttgataagtgggattatagttattattagttattgagaagagtgttttttatttatagagtgtaa

SEQ ID NO: 15355 - DNA, 201 bp, Artificial Sequence
  Description of Artificial Sequence: Synthetic polynucleotide
ttaaatttttagagggtttattgtaagattttttttgggtttgaaagtttaagatgaataatttttttttttttaggtttagttttaaggtgtaatttgtgttagtagggtgtgttagtagggtgtgttagtagggtgtgttagtagggtgtgttagtagggtgtgttagtagggtgtgttagtagggtgtgttagtaggg

SEQ ID NO: 15356 - DNA, 686 bp, Artificial Sequence
  Description of Artificial Sequence: Synthetic polynucleotide
attatgttttagtttttttggttgtttttatttttaaatatttgaaaaatagaggtgttgggtgtgaggtggagagatgtataggtttggttttggttttgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgtgagttttgttttgttttgtattaagtttgtattttttaggtttttggtatttttgtttttgggatgtggggtttttatagatttggaaatttttgtttgtttttttttatttagagtaaattgagatgtttataagagtttggaagttgtttttttttgggtttgaagttgtttggaggttggttttgtttttggtttttttgttatagggtaatgtatatattttttattgtatagtttttttgtttaaaattttgttgatttattttgttttttgttttttaaagtttttatttgtgtgttggatttttgttttgggtgttttttagtttttgttggttttttttggagtgtagtgttggggttttagttttggggaggttgggttttttgtttggttttgggagtttgtaggtgttat

SEQ ID NO: 15357 - DNA, 201 bp, Artificial Sequence
  Description of Artificial Sequence: Synthetic polynucleotide
aggttggtagattatgaggttaggagattgagattgttttggttaatatggtgaaattttgtttttattaaaaatataaaaattagttgggtgtggtggtgtgtttttgttttagttgttggggaggttgaggtaggagaatggtgtgaatttgggaggtggagtttgtagtgagttgagattgtattattgtattttagt

SEQ ID NO: 15358 - DNA, 201 bp, Artificial Sequence
  Description of Artificial Sequence: Synthetic polynucleotide
tattgtaagttttgttttttgggtttatgttgttttgttgattttgtgatttgttttgttttggttttttaaagtgttgggattataggtgtgagttattgtgtttggttaatagtttttaatattaattatttagagtgtgtaataatttggaaaagggtttttttttttttttttgtttttagagatagggtttttggt

SEQ ID NO: 15359 - DNA, 201 bp, Artificial Sequence
  Description of Artificial Sequence: Synthetic polynucleotide
tgggagtgatttgatttttaaggtgtgtttgttatttttttttttgatttagaaagggaattttttgattttttgtgttttttaagtgaggtagtgttttgttttgttttggtttgtatatggtgtatgtatttattgatttgtgtttattgtttggtattttttagtgagatgaatttggtattttagatggaaatgtag

SEQ ID NO: 15360 - DNA, 201 bp, Artificial Sequence
  Description of Artificial Sequence: Synthetic polynucleotide
attttataaaaatgaaaattaaataagtataagaatggttatatttgggggaggagttaatatggttgaataggaatagttttggtttatagtttttagtgtgagtgatatagaagatggtgatttttgtatttttaattgaggtattgggtttattttattagggattgttagatagtgggtgtaggttagtgggtgtgt

SEQ ID NO: 15361 - DNA, 201 bp, Artificial Sequence
  Description of Artificial Sequence: Synthetic polynucleotide
tggggttttattttgttagttaggatggttttgattttttgattttgtggtttgtttgttttggttttttaaagtgttgggattatagatttgaattattgtgttgggttagttttgtgggtttttaatgtgtttttttttatttgtaatttagagttagaagaggttagtgttgataggtaggtagtagttatatgaaaa

SEQ ID NO: 15362 - DNA, 201 bp, Artificial Sequence
  Description of Artificial Sequence: Synthetic polynucleotide
ttattaaaaatataaaaaattagttgggtgtggtggtgggtgtttgtaattttagttatttgggaggttgaggtagaagaatggtatgaatttaagaggtggagtttgtagtgagttgggatagtgttattgtagtttagtttgggtgaaagagtgagattttgttttaaaaaaaaaaaaaaaaaaaaaaaaaaaagattt

SEQ ID NO: 15363 - DNA, 201 bp, Artificial Sequence
  Description of Artificial Sequence: Synthetic polynucleotide
ggagggtggtgagggtggggagggggaaggtgggaggttgggtttggtgtatgggggttgggtatattttttttgggtatttttaggataggtgaggaatgtattggttgggattttatttatgagtaggagggtaaggtgtagtttgtgattgatgtggtgtatgttattgtttatgttttttatagtatgtattaggtg

SEQ ID NO: 15364 - DNA, 201 bp, Artificial Sequence
  Description of Artificial Sequence: Synthetic polynucleotide
ttatataagttgtagtttgggtagatgttgtatttgtagtgggtttttattataggtttattgtagttattgtagattatattggggtgtattatgttgtggggtgttttttgagtatatggtgggtggtggttttgttggtatttttttttttttataggaagggtaaagagagttgttagggtgggattttttaaagtt

SEQ ID NO: 15365 - DNA, 201 bp, Artificial Sequence
  Description of Artificial Sequence: Synthetic polynucleotide
tatggggaaattttgtttttattaaaaatataaaaattagtttggtgtggtggtatataattgtaattttagttatttgggaggttgaggtaggagaattgttggaatttgggaggtggagtttgtagtgagttaagattgtgttatgtattttaatttgggtgttgtagtgagattttgtttttaaataaataaagtgtt

SEQ ID NO: 15366 - DNA, 201 bp, Artificial Sequence
  Description of Artificial Sequence: Synthetic polynucleotide
agtaattaataaagtgaagatatggtttattgaagtgtagaaaatatttataagttgggtgtggtagtttatgtttgtaattttagtattttgggaggttgagatatgtggattataaggttaggagattgagattattttggttaatatagtgaaattttgtttttattataaatagaaaaaattagttgggtatggtgg

SEQ ID NO: 15367 - DNA, 227 bp, Artificial Sequence
  Description of Artificial Sequence: Synthetic polynucleotide
agattggttttttttatttaataatatgtattttaatttttagggttgggtgtggtggtttatgtttgtaattttagtattttgggaggttgaggttggtggattatgaggttaggagattaagatgattttggttaatatggtgaaattttgtttttattaaaaatatagaaaataagttgggtgtggtggtgggtatttgtagttttagttatttaggaggttga

SEQ ID NO: 15368 - DNA, 201 bp, Artificial Sequence
  Description of Artificial Sequence: Synthetic polynucleotide
gttttttttttgagttaaagaaaggggtgatggatgtatttggaaaattgggttatttttatttgaatattgtgtttttttgattggtttaaaaaatggtgtattatgagattatattttatatttggtttggagttttgttgattgttagtatagtagtttgagattaaattgtaaggtggtagtaaggttgggggaggg

SEQ ID NO: 15369 - DNA, 201 bp, Artificial Sequence
  Description of Artificial Sequence: Synthetic polynucleotide
atgtagaagatgggtgatttttgtatttttatttgaggtattgggtttattttatttgggagagttagatagtgggtgtaggttagtgggggtatgtattgtgtgtgagttgaagtagggagaggtattgttttatttgggaagtgtaaggggttagggagttttttttttgagttaaagaaaggggtgatagatgtattt

SEQ ID NO: 15370 - DNA, 201 bp, Artificial Sequence
  Description of Artificial Sequence: Synthetic polynucleotide
ggtatttgttattatgtttggttaattttttgtatttatagtatagatggggttttattgtgttagttaggatggttttgattttttgattttgtgatttgtttgtttttgttttttaaagtgttgggattataggtgtgagttattgtgtttggtggaaaggatatttttttatagtatgagtattgaaataaaaaggta

SEQ ID NO: 15371 - DNA, 201 bp, Artificial Sequence
  Description of Artificial Sequence: Synthetic polynucleotide
aattgtgttattggaagttaggaagtaaattttaattttagtattgtttttttttgaaatggagttttgttttgttatttaggttggagtgtagtggtgtgattttggtttattgtaagttttgttttttgggtttattttatttttttgttttagttttttgagtagttgggattataggtgtttgttattatgtttggt

SEQ ID NO: 15372 - DNA, 201 bp, Artificial Sequence
  Description of Artificial Sequence: Synthetic polynucleotide
tttgggtgattgtttgtaatggagggagtgtgtgggttggtttgttagtggagagatttgttttatgttattaggagtttggttgagtattatggtgattgtggttgggtggaaggagatggatgtttatttgtgtaatttgtttttattttttttttaggggttattttagaataaaatgtaatggtttttttttgttta

SEQ ID NO: 15373 - DNA, 201 bp, Artificial Sequence
  Description of Artificial Sequence: Synthetic polynucleotide
ataagttggttgtttggtaggttatattggggtttttaagagtttgggttgtagatgaatttaggtttgttttttttaattagtgtgatttgggtaagttgtgttttttttttgagttttagtttttttattttttaaatgggggtgatgttatttttattgttaggggtttttttgagtgggttataggaaggtgtttag

SEQ ID NO: 15374 - DNA, 201 bp, Artificial Sequence
  Description of Artificial Sequence: Synthetic polynucleotide
tttagtttgggattggtagtatttttatttgtatgttatttttagggatggtaatattgtttattttgagtttagagtagttattatttttggtttttttgttggttttttgggaggttttaggaagatgtgattttttgttaggtatttgtgggtttttttatagttgttggggtggtttttgtttttttaaaattatat

SEQ ID NO: 15375 - DNA, 201 bp, Artificial Sequence
  Description of Artificial Sequence: Synthetic polynucleotide
aaagttattgtaggtaattagaaaagttgtttttattttatggttgtgtttatttgtggtagataggataatggtttaaagatgtttgagatttgtgattgttttattttgtgattgtattattttatatggtaaagaagtttttgtatgtgtgattatgattaaggattttgagatttggagatgatttgggtatttggg

SEQ ID NO: 15376 - DNA, 201 bp, Artificial Sequence
  Description of Artificial Sequence: Synthetic polynucleotide
gtggtggtaggtttgttgtgtttgttttagttagggtttagagttttttggttagtttattgtatttggattttagatgggtgtgttgggtggtgtttgtgttagggaaagagttggtggttggttgagttgttgtgtttttgagtgttgtgtttgttgtgattattggtgtggttgttttttggtaggtttgaaggaatc

SEQ ID NO: 15377 - DNA, 201 bp, Artificial Sequence
  Description of Artificial Sequence: Synthetic polynucleotide
tttttgatattttgtttttatattgtattatttgttggtaattgtttttggatagtggttaggttgtggggaggttggttttggagtttatttttggggtgtatatttttgttaatttttttgaggtggggtataggattgtggtgttgtattatggggatttgttttttttggggttttattatttgttgttatttaagg

SEQ ID NO: 15378 - DNA, 201 bp, Artificial Sequence
  Description of Artificial Sequence: Synthetic polynucleotide
gggtttagaggtattttagtaaatggtttaggaattgtagtattaatttatattgagaaatagaattgttatttaagaaagataattgttggtttaatgtggtggtttatgtttgtaattttagtattttgggaggttgaggttggtggattatgaggttaggagattgagattattttggttaatagggtgaaattttgt

SEQ ID NO: 15379 - DNA, 201 bp, Artificial Sequence
  Description of Artificial Sequence: Synthetic polynucleotide
tatggtgaaattttgtttttattaaaaatataaaaaattagttaggtgtggaggtattttttgtaattttagatatttaggaggttgaggtaggaaaattgtttgaatttgggaggtggagtttgtagtgagttgatattgtattattgtgttttagtttgggtaatagagtaaaattttgttttaaaaaaaaaaaaaaaa

SEQ ID NO: 15380 - DNA, 201 bp, Artificial Sequence
  Description of Artificial Sequence: Synthetic polynucleotide
tatttttttgttttagttttaggagtagttgggattataggtgtttgttataatgtttggttaattttttttgtatttttagtggagatggggttttattgtgttagttaggatggttttgattttttgattttgtgatttatttgttttagttttttaaagtgttgggattataggtgtgagttattgtgtttagttgtt

SEQ ID NO: 15381 - DNA, 201 bp, Artificial Sequence
  Description of Artificial Sequence: Synthetic polynucleotide
gtttatagtttttagtgtgagtgatgtagaagatgggtgatttttgtatttttatttgaggtattgggtttattttattagggagggttagatagtgggtgtaggttagtgggtgtgtgtattgtgtgttagttaaagtagggtaaggtattgttttatttgggaagtgtaaggggttagggagttttttttttgagttaa

SEQ ID NO: 15382 - DNA, 201 bp, Artificial Sequence
  Description of Artificial Sequence: Synthetic polynucleotide
tggtaaaattttatttttattaaaaatataaagatttagtatgggtatggtggtgtatatttgtaattttagttgtttgggaggttgaagtagaagaattgtgtgaatttgggaggtagaagttgtagtgagttaagattatgttattgtattttagtttgggtgatataatgagattttgtttaaaaaataaaataaaaa

SEQ ID NO: 15383 - DNA, 201 bp, Artificial Sequence
  Description of Artificial Sequence: Synthetic polynucleotide
aaattttttatttttttgaggtagagttttattttgttgtttaggttggagtgtagtagtgtgattttggtttattgtaagttttattttttgggtttatgttatttttttgttttagttttttgagtagttgtgattataggtgttttttattatgttgggttaattttttgtatttttagtagagatggggttttattg

SEQ ID NO: 15384 - DNA, 201 bp, Artificial Sequence
  Description of Artificial Sequence: Synthetic polynucleotide
ttttgagtagttgggattataggtgtttgttattatgtttggttaatattttgtatttttagtagagatggggttttattgtgttagttaggatggttttgattttttgattttgtgatttgtttgttttggttttttaaagtgttgggattataggtgtgagttattgtgtttggtttattttttttattttttatagag

SEQ ID NO: 15385 - DNA, 201 bp, Artificial Sequence
  Description of Artificial Sequence: Synthetic polynucleotide
tgagttgagtggagattgtgttattgttttttagtttgggtgatagagggagattttgtgtttaaaaaaaatagatgtaggtaggagttttttttttggtgtttatatttagattgaagaaagtaattgggttgggtttggtggtttagatttgtaattttagtattttgggaggtttaggtagatgtattattttagttt

SEQ ID NO: 15386 - DNA, 201 bp, Artificial Sequence
  Description of Artificial Sequence: Synthetic polynucleotide
ttggagtagtggtaggtggtaagggttgggtggggggttgttttattgggttttttattttttttttttttttttaattttttttttttttttttgagatggagttttgttttgttatttaggttggagtaaagaggtatgattttggtttatagtaatttttgttttttgggtttaagtgatttttttgttttatgtttt

SEQ ID NO: 15387 - DNA, 201 bp, Artificial Sequence
  Description of Artificial Sequence: Synthetic polynucleotide
tgaagggagggatgagagttttattatttaattttaagtttagtggttggtgtttttggaagtggagatatatgtttattggtgtgtgatttatatttatgaaagggaatgtgttttttggaatataggggagttttggttagggaagttgtttttttatttaagagggataaaggtgtgtaaattttagaaattagatat

SEQ ID NO: 15388 - DNA, 201 bp, Artificial Sequence
  Description of Artificial Sequence: Synthetic polynucleotide
aaattatttttgatttgagatataaaaataaagaggttgggtgtaaggtggtttatgtttgtaattttagtattttgggaggttgaggtgggtggattatgaggttagtagattgagattattttggttaatatggtgaaattttgtttttattaaataaaatataaaaaattagttgggtgtggtggtgggtgtttgtag

SEQ ID NO: 15389 - DNA, 217 bp, Artificial Sequence
  Description of Artificial Sequence: Synthetic polynucleotide
ttttgaatgaaattaggaaggagaaagtatgggataatgggtttttgataatgataaaaagagaaaaaataaatagaaaaaagaggagggttggttgggtgtggttaggaaggtgtggttttggttaggagattgagattattttggttaatgtggtgaagttttgtttttattaaaaatataaaaaattagttgggtgtggtggggggtgtttgta

SEQ ID NO: 15390 - DNA, 217 bp, Artificial Sequence
  Description of Artificial Sequence: Synthetic polynucleotide
ttgttatttttttttttgattgggaaagggaattttttgattttttgttttttttaagtgaggtagtgttttgttttgttttggtttgtgtatggtgtatgtatttattgatttgtgtttattgtttggtattttttagtgagatgaatttggtattttagatggaaatgtagaaattatttgttttttgtgttgtttaagttgggagttgtagatc

SEQ ID NO: 15391 - DNA, 201 bp, Artificial Sequence
  Description of Artificial Sequence: Synthetic polynucleotide
tgttggtgggagttaaaatggattaattatataaaaaataatttttaggttgggtgtagtggtttatgtttgtaattttggtattttgggaggttaaggtgggtggattatgaggttaggaaattgatattattttggttaataaggtgaaattttatttttattaaaaatataaaaatttagttgggtgtggtggtgggt

SEQ ID NO: 15392 - DNA, 201 bp, Artificial Sequence
  Description of Artificial Sequence: Synthetic polynucleotide
tggagattttttatttattgtggtagtaaatttgtttgaggtgtttgtatgttttagttttggggttttgggggttgtgtttatagtttttttattttttggtttttatgttagggtttttggtttatattgtgttgttttgttttatatgagattggaaagttatatgtggataatttaggatttatttagggttatata

SEQ ID NO: 15393 - DNA, 201 bp, Artificial Sequence
  Description of Artificial Sequence: Synthetic polynucleotide
gtagggtttgaattttttttttaggagggttagggttgtggttgggtgatgttaggtggggaagatattagaagaggagaaaattaggagtgtaggatgtggtgggagattgggaggttgtagagaggaggtttgaggataggagggaaggaggtggggatagaggttgagggttggaggggttgttgggttttttttggg

SEQ ID NO: 15394 - DNA, 201 bp, Artificial Sequence
  Description of Artificial Sequence: Synthetic polynucleotide
gttattgtgtttggttaatttttttgtatttttttagtagagttggggttttattgtgttagttaggatggttatgattttttgattttgtgatttggttgttttggttttttaaagtgttgggattataggtgttaagttattgtgtttggttgatagttagatttttaaaggtgtttgaatttttttaatgtggaaata

SEQ ID NO: 15395 - DNA, 201 bp, Artificial Sequence
  Description of Artificial Sequence: Synthetic polynucleotide
agtttatgtatggtgtgtgtatttattgatttgtatttattgtttggtattttttagtgagatgaatttggtattttagatggaaatatagaaattatttgttttttgtgttgtttatagtgggagttgtagattggagttgtttttatttggttattttggtttgatttggagtggtatatgtttttaaataattaaatt

SEQ ID NO: 15396 - DNA, 201 bp, Artificial Sequence
  Description of Artificial Sequence: Synthetic polynucleotide
ttggtgagaagttgagtatagtagttgttggtttaggtgttaagttttttattgtttggggttgttggttgttttaagtgtgggttagtttagtttatgtgtatttggaagttgtgttggtgagggagggttgtgagggttgttagtatgttattattttttattgggattataggtgtgagttatggtgtttggttgaag

SEQ ID NO: 15397 - DNA, 201 bp, Artificial Sequence
  Description of Artificial Sequence: Synthetic polynucleotide
ttatgttatttttttgttttagtttgtagttgggattataggtgtttgttattatgtttggttattttttttgtatttttaatagagatggggttttattgtgttagttaggatggttttaatttgttgattttgtgatttgtttgttttggttttttaaagttttgggattgtaggagtgagttattgtgtttggttgta

SEQ ID NO: 15398 - DNA, 201 bp, Artificial Sequence
  Description of Artificial Sequence: Synthetic polynucleotide
tagattggagtgtagtggtatgattttggtttagaatttttgttttatgggtttaagtaatttttttgttttagtttttggagtagttgggattataggtgtttgttattatgttaggttaattttttgtatttttagtagggatggttgattgggtgtggtggtttatgtttgtaattttagtattttgggaggttgagg

SEQ ID NO: 15399 - DNA, 201 bp, Artificial Sequence
  Description of Artificial Sequence: Synthetic polynucleotide
tattttttagatgggatagtggttgggaagaggtgttttttattttttagatgggatggtggttaggtagagatgttttttattttttagatggggtggtggttgggtagaggttgtaattttggtattttgggaggttaaggtaggttgttgggaggtgaaggttgtagtgagttgagattatgttattgtattttagtt

SEQ ID NO: 15400 - DNA, 201 bp, Artificial Sequence
  Description of Artificial Sequence: Synthetic polynucleotide
gatggagttgtttgttagttttggtattgtgtgtttgtattttttagtttttgggtggttaatgggattgggtgttgtggagtagggggtggtgtttgttggggaggtttgggttgtataggagtttatggaaggggtgggaggtttaggtatggtgggttgtaggttttgagttttgttttgtgggaaggtagttaaggt

SEQ ID NO: 15401 - DNA, 286 bp, Artificial Sequence
  Description of Artificial Sequence: Synthetic polynucleotide
gagttaggtgtgggatatagttttgtggtgtattgttttttaagttggtttgaaaagtgtaataattgggtgggagtgatttgattttttaggtgtgtttgttatttatttatttgatttggaaagggaattttttgattttttgtgttttttaggtgaggtaatgttttgttttgttttggtttgtgtatggtgtgtgtatttattggtttgtgtttattgtttggtattttttagtgagatgaatttggtattttagatggaaatgtagaaattatttgttttt

SEQ ID NO: 15402 - DNA, 201 bp, Artificial Sequence
  Description of Artificial Sequence: Synthetic polynucleotide
aggtaaagttgtttgttagttttatgttttgtgtttatgttttttagttgttttatagttgatgggattgggtgttatggagtagggggtggtgtttgttggggaggtttttgttgtataggagtttagggtagtggggggaggtttatatatggtaggttgtaggttttaagttttgttttgtagggaggtagttgaggt

SEQ ID NO: 15403 - DNA, 201 bp, Artificial Sequence
  Description of Artificial Sequence: Synthetic polynucleotide
aggtgggtggattatgaggttaggggtttgagatgagtttggttaatatggtgaaattttgtttttattaaaaatataaaaattagttgggtgtggaggtgtgtgtttgtaattttagatatttgggaggttgaggtaagagaattgtttgaatttgggaggtggaggttgtagtgagttgagatggtgttattgtatttt

SEQ ID NO: 15404 - DNA, 201 bp, Artificial Sequence
  Description of Artificial Sequence: Synthetic polynucleotide
gagtgatgtagaagatgggtgatttttgtatttttatttgaggtattgggtttattttattagggagtgttagatagtgggtgtaggttagtgggtgtgtgtaatgtgtgtgagttgaagtagggtgaggtattgttttatttgggaagtgtaaggggttagggagttttttttttgagttaaaggaaggggtgatggagg

SEQ ID NO: 15405 - DNA, 201 bp, Artificial Sequence
  Description of Artificial Sequence: Synthetic polynucleotide
gtgttgtttgttatttttttttttgattaggaaagggaattttttgattttttgtgtttttggagtgaggtaatgttttgttttgttttagtttgtatatggtgtatgtatttatggatttgtgtttattgtttggtattttttagtgagatgaatttggtattttagatggaaatgtagaaattatttgttttttgtgtt

SEQ ID NO: 15406 - DNA, 201 bp, Artificial Sequence
  Description of Artificial Sequence: Synthetic polynucleotide
atttttatttgaattttgatagtagttattatgtagagttgttaaaatgtatatttttggttgggtgtggtggtttatgtttgtaattttagtattttgtggggttgaggtgggtggattatgaggttaagagattaagattattttggttaatatggtgaaattttgtttttattaaaaatataaaaaaaattagttggg

SEQ ID NO: 15407 - DNA, 201 bp, Artificial Sequence
  Description of Artificial Sequence: Synthetic polynucleotide
ttaggtgttatttgttatttttttttttgatttagaaagggaattttttgattttttgtgttttttaggtgaggtaatgttttgttttgttttggtttgtgtatggtgtgtatatatattggtttgtgtttattgtttggtattttttagtgagatgaatttggtattttagatggaaatgtagaaattatttgttttttg

SEQ ID NO: 15408 - DNA, 201 bp, Artificial Sequence
  Description of Artificial Sequence: Synthetic polynucleotide
tttagtttattgttgtattgtgagagtttttttttgggttggttaaggttagagtttgtttttttagtttgtagggaggtgtggatggagaggtgtgagtgggaatttaggttgtgtatggtgtttgtgggttagttggagttttgggtgggtgtgggtttggtaggttttgtattgggagtagttggttggttttgttag

SEQ ID NO: 15409 - DNA, 201 bp, Artificial Sequence
  Description of Artificial Sequence: Synthetic polynucleotide
ggggagagggattgattttttgtgttttatttttagtttatttaattttagtgtagtttggagattgttattgtgttttttggagggtgatggagtttttgttttgtttaggagtagtttggtttttgggagggtagtttgatttttatggtattgttggtgattttttagtttaggttttggggttgtgagaattttaag

SEQ ID NO: 15410 - DNA, 201 bp, Artificial Sequence
  Description of Artificial Sequence: Synthetic polynucleotide
atgagtgttattgatggtagagttgttttttttatgttttgtggggattgggaagagattgtagggagtgaggtattttatttgtttatttggtagatttgaagattgagatttgagagtttgtagttttgggttatatttttagtgtttggtttagttttttttttatttttttatttgttttttgtagatgaggggttt

SEQ ID NO: 15411 - DNA, 201 bp, Artificial Sequence
  Description of Artificial Sequence: Synthetic polynucleotide
gttgtaattttattgagtgtgtttgtttattagatatttgattttgtaagattgttttttttttttttttttgatggagttttgttttgttgtttaggttgaagtgtagtggtgtgattttggtttattgtaagttttgttttttgggtttatgttatttttttgttttagttttttgagtagttgggattataggtgttc

SEQ ID NO: 15412 - DNA, 210 bp, Artificial Sequence
  Description of Artificial Sequence: Synthetic polynucleotide
ttttgggtttttattttttttttttttttttttttttttttgagatgaagttttattttgttgtttgggttggagtgttgtggtaggattttggtttattgtaagttttgttttttggatttatgttatttttttgttttagttttttgagtagttgggattagaggtgtttgttattgtgttaggttaatttttttgtatttttagtag

SEQ ID NO: 15413 - DNA, 201 bp, Artificial Sequence
  Description of Artificial Sequence: Synthetic polynucleotide
taagttgggtgtggtggtttatgtttgtaattttagtattttgggaggtttaggtaggtggattatgaggttaggagattaagattattttggttaatatggtgagaattttgtttttataaaaaatataaaaaattagttgggtgtttgtagttttagttatttgggaggttgaggtgagagaatggtgtgaatttgggg

SEQ ID NO: 15414 - DNA, 201 bp, Artificial Sequence
  Description of Artificial Sequence: Synthetic polynucleotide
gggttaaagaggaattggaaagggtttggggtagatgtgggtgttatagggtgagttgggttaggttgagaggatttatgggttatgggagtttgtgggtgatggtttggtaggggtttgtggtgggaatagggataaaatatatttaataaattgtttatttagagtaagttgtgtgggtataatggtgagaaaatggtt

SEQ ID NO: 15415 - DNA, 201 bp, Artificial Sequence
  Description of Artificial Sequence: Synthetic polynucleotide
ggtgggtgggttatgaagttaggagattgagattattttggttaatatggtgaaattttatttttattaaaaatataaaaaattagtttggtatagtggtgggtgtttgtagttttagttagtttggaggttgaggtaggagaatggtgtgaatttgggaggtggagtttgtagtgagttgagattgtgttattgtattat

SEQ ID NO: 15416 - DNA, 201 bp, Artificial Sequence
  Description of Artificial Sequence: Synthetic polynucleotide
gtttatgttattttaatagtgggtttttttttggtgagaattggttaatagttattgttttgtttttttagtatgttgtttgattagagagggatagggtggggaggaaaattggggtgttgtgggttgtagttttagttgtaaatatgggagttttttttgatgtttgtggtttgttggtttgaaagggagaaatatgga

SEQ ID NO: 15417 - DNA, 201 bp, Artificial Sequence
  Description of Artificial Sequence: Synthetic polynucleotide
ttatgaatttttgagtttaagtgatttttttatttggttttgtgaagtgttgggattatatgtgtgagttattatgttgggattataggtgtgagttattgtgttgggattatgggtatgagttattgtgttggtttttagtaaatattttattagtatttagtgaattttgggtttttgtggaataggaatgtttgtttt

SEQ ID NO: 15418 - DNA, 201 bp, Artificial Sequence
  Description of Artificial Sequence: Synthetic polynucleotide
aggttgaggttggtggattataaggttaggagattgagattattttggttaatatggtgaaattttgtttttattaaaaatataaaaaaattagttgggtgtggtggtgtgtatttgtagttttagttatttgggagtttgaggtaggagaatggtatgaatttgggaggtagagtttgtagtgagttaaaattgtattat

SEQ ID NO: 15419 - DNA, 201 bp, Artificial Sequence
  Description of Artificial Sequence: Synthetic polynucleotide
aaggagatgtttgggttaggattgaagttttttggaataatgggttgggattttgaggttggtaggggtgtagtgggtattgggtttatgtgtggtttgtgttggttgatgtgggtatataaggggtatagttgttattgggggtttggaggggaggatttagttggggtttggagggttaggattttgtagaaggtttac

SEQ ID NO: 15420 - DNA, 201 bp, Artificial Sequence
  Description of Artificial Sequence: Synthetic polynucleotide
tatggtgaaattttgttttaattaaaagtattaaaattatttgggtatggtggtatatgtttgtaattttagttatttgggaggttgaggtaggagaattgtttgagtttgggaggtggaggttgtagtgagttgtgattgtgttattgtattttagtttgggtgatagagtaagattttattttaataaaaaaattaaaa

SEQ ID NO: 15421 - DNA, 201 bp, Artificial Sequence
  Description of Artificial Sequence: Synthetic polynucleotide
gtgatttttttgttttagttttttgagtagttaggattataggtgtttgtttttatgtttggttaattttttgtatttttggtagagatggggttttattgtgttagtaaggatagttttgattttttgattttgtgatttgtttgttttggtgttttaaagtgttgggattataggtatgagttattgtgtttggtgggg

SEQ ID NO: 15422 - DNA, 201 bp, Artificial Sequence
  Description of Artificial Sequence: Synthetic polynucleotide
agtgaaatttttttttattaaaaatttaaaaaaattagttgggtgtggtagtatgtgtttgtagttttagttatttgagaggttgagataggagaatggtgtgaatttgggaggtggagtttgtagtgagttgagattgtgttattgtattttagtgtgggtgatagagtaagattttgttttaaaaaaaaagaaaataat

SEQ ID NO: 15423 - DNA, 201 bp, Artificial Sequence
  Description of Artificial Sequence: Synthetic polynucleotide
agattatagatgaatttgaattttaagtagtatagatgtgttatatttattattttgttgttgattatttttgggattatattatatttattattttgttgttgattatttttgggattattatggtgggttatgatagtatgttttttttagaaatatgtttgaatagtataagaaaaggatattatttggatttgtgga

SEQ ID NO: 15424 - DNA, 201 bp, Artificial Sequence
  Description of Artificial Sequence: Synthetic polynucleotide
tgttgttatttataagagtttttttttttttgtaattaatggttttgtttttggtttgtttagtaaattgaaattattgaaaaaggattttgttgggagtggtggtttatgtttgtaatattagtattttgggaggttgaggtgggttgattataaggttaggaaattgagattattttggttaatatggtgaaatttagt

SEQ ID NO: 15425 - DNA, 201 bp, Artificial Sequence
  Description of Artificial Sequence: Synthetic polynucleotide
ttagagttaggtgtttattgttaatttggagtgtgtgttttagttttttggggttgattttggttgttgggttagtagtgtgaattttttttttttatatggggtttttaagatatgtgtttgtgtgtgtttgtttttaagatatgtgtgtgtgtatatgtgtgtgtgtgtgtgtgttttatatgaatgatttgagttatt

SEQ ID NO: 15426 - DNA, 201 bp, Artificial Sequence
  Description of Artificial Sequence: Synthetic polynucleotide
gttagtgtttttatggtagtttttgtattgggtttggggtgggggtggggggtggttgtggagtttttggtttttatttagtgtgttttttttatggggtgtattttaaagtgataagatgttttttaggaaatggggaatggatgttaggtttttagggagaggttgaggtagtttgaggtaaaaagggatgggttgagg

SEQ ID NO: 15427 - DNA, 201 bp, Artificial Sequence
  Description of Artificial Sequence: Synthetic polynucleotide
gggtgtttatggagtttttagtttttatttagggtgtgtgttttttttatggggggtattttaaaggggtatgaagttttttgggggatggggatatgatgttaggtttttagtgggatattgagatagttgggggaaaaaagttgggagggtaagaaggttggggtatttttatggaggttagtttttttttagtagttt

SEQ ID NO: 15428 - DNA, 201 bp, Artificial Sequence
  Description of Artificial Sequence: Synthetic polynucleotide
gtatttattgttttgtattaattgtttagtattttttagtgagatgaatttgttattttagttggaaatgtagaaattatttattttttgtgttgtttatgttgggagttgtagattggagttgtttttatttggttattttggttttattttattatattttttttatttagtttattattgatggatatttgggttggt

SEQ ID NO: 15429 - DNA, 201 bp, Artificial Sequence
  Description of Artificial Sequence: Synthetic polynucleotide
gtaggtgttagggagaggtaattttttaaatagataaaaatatttttggttgggtgtggtggtttatgtttgtaattttagtattttgggaggttgatgtgggtggattatgaggttaggagattgagattatttttgttaatatggtgaaattttgtttttattaaaaatataaaaaattagttgggtgtggtggtgggc

SEQ ID NO: 15430 - DNA, 201 bp, Artificial Sequence
  Description of Artificial Sequence: Synthetic polynucleotide
tggttttattatgttagttaggatggttttaattttttgattttgtgatttgtttgttatggtttttgaaagtgttgtgattataggtatgagttattgtgtttggtttaaaataatttttgaggttatataagaatatagtttatgtttatttatagttgtatttaatttaattaagaatttgttttttaagatgaaaaa

SEQ ID NO: 15431 - DNA, 201 bp, Artificial Sequence
  Description of Artificial Sequence: Synthetic polynucleotide
tgggtttttgatttgtgtggatgagtagttttgagttttatatagggtgggtgatgttgtagattgataaggtttatttttggttatattgagttaaagtggaaggggtgtaggtgtggagtgttatgtgtgatgttattgttggttagttggagtggaggtgtttgttatgtgtatggggagatgtgtttttggttagtt

SEQ ID NO: 15432 - DNA, 366 bp, Artificial Sequence
  Description of Artificial Sequence: Synthetic polynucleotide
ttgttttgtagtttgattttagattgttgtgttagtaattagtgagattttgtgggtgtaggattttttaagttaggtgtgggatatagttttgtggtgtgttattttttaagttggtttgaaaagtgtaatatttgggtgggagtgatttgattttttaggtgtgttggttatttttttttttgatttggaaagggaattttttgatttttggtgttttttaggtgaggtaatgttttgttttgttttggtttgtttatggtgtgtgtatttattggtttgtgtttattgtttggtattttttagtgaggtgaatttggtattttagatggaaatgtagaaattatttgttttttgtgttgttta

SEQ ID NO: 15433 - DNA, 201 bp, Artificial Sequence
  Description of Artificial Sequence: Synthetic polynucleotide
ggtttttgtagggttgagtttttttaatgagtgttgttttttgttttatggtgtttggttttattgattgtttaagggttgaggattgtgggagtattgtgtgggattggtaggtagttttatttgtggtttttggtgtgggatttattgggtgaagttagttgggtttgtgagtttagtgtggatttggagaatttttat

SEQ ID NO: 15434 - DNA, 201 bp, Artificial Sequence
  Description of Artificial Sequence: Synthetic polynucleotide
tgtagaagatgagtgatttttgtatttttatatgaggtattgggtttattttattagggagtgttagatagtgggtgtaggatagtgggtgtagtgtattgtatgtgagttgaagtagggtgaggtattgttttattttggaagtataaggggttagggagtttttttttttagttaaagaaaggggtgatagatggtatt

SEQ ID NO: 15435 - DNA, 201 bp, Artificial Sequence
  Description of Artificial Sequence: Synthetic polynucleotide
tttttttttttagttaaagaaaggggtgatagatagtatttggaaaattgggttattttaattggaatattgtatttttttaataggtttaaaaaatggtgtatttggagattgtattttgtatttggtttggagggttttatgtttatggagttttgttgattgttagtatagtagtttgagattaaattgtaaggtggt

SEQ ID NO: 15436 - DNA, 384 bp, Artificial Sequence
  Description of Artificial Sequence: Synthetic polynucleotide
tttgtttttttggtttttgttgtttatgagaaatgaggaaaaataaaggttagatttttaataatttttttggaagaaagagttgttttgagtgggtgttggtgtttatatatgttgtttttaaaaaaatttgttttgtttaggtttgtgtgaatataatgttggatgaattttgtttttttagaagaaagttgggttggtgtgtttgatgatgtagtgtttgtagtggtgtttgataaagtgtagggtttttatggagattttgtagttttggatatttagtgtttggaggttaaagtagttggtggttatgatttgtaagttttggttggtgatgtttttgtaggatttgaggttgagttgtttgaggttgaagtagtttag

SEQ ID NO: 15437 - DNA, 216 bp, Artificial Sequence
  Description of Artificial Sequence: Synthetic polynucleotide
tgggagtgatttgattttttagttgtgtttattatttttttttttgatttggaaagggaattttttgattttttgtgttttttaggtgaggtaatgttttgttttgttttggtttgtgtatggtgtgtgtatttattggtttgtgtttattgtttggtattttttagtgagattaatttggtattttagatggaaatgtagaaattatttgttttt

SEQ ID NO: 15438 - DNA, 334 bp, Artificial Sequence
  Description of Artificial Sequence: Synthetic polynucleotide
ttgtgttggtaattagtgagattttgttgggtaggattttttgagttagatgtgggatataattttgtggtgtgttgttttttaggttggtttgaaaagtgtaatatttgggtgggagtgatttgattttttaggtgtgtttgttatttttttttttgattaggaaagggaattttttgatttttggtgttttttgagtgaggtattgttttattttgttttggtttgtgtatggtgtgtgtatttattgatttgtgtttattgtttggtattttttagtgagatgaatttggtattttagatggaaatgtagaaattattgttttttatgtta

SEQ ID NO: 15439 - DNA, 201 bp, Artificial Sequence
  Description of Artificial Sequence: Synthetic polynucleotide
tttgatgtaaggtggggtaggtaaaagtttggtagttatttgagaaggtgtgattaaaatggaggaatttgagagattttttgaggattgtaggtttggtgtggagtttgtgtttaatggtttggtttatggtagtgtggaggttattttggttttaatgtttggtgtttttgggttgtattagtaagattttaggatttt

SEQ ID NO: 15440 - DNA, 270 bp, Artificial Sequence
  Description of Artificial Sequence: Synthetic polynucleotide
ttttggtttttgtttgtgtttttttttttatatttttttgtaagttgagggagttggttttggttttggttagtttaggaatgggtttttatagtgtagtggtgggttgaagggttttttaagtgtggttagagtgggtgttaaggttgaggaggtgttaagagtgagtgagggttgtgagggttgttatgttggtatattgttattttttagaaggatgtagggtagagttttaggttggttttgttatttatgttggagtgtagtggt

SEQ ID NO: 15441 - DNA, 253 bp, Artificial Sequence
  Description of Artificial Sequence: Synthetic polynucleotide
ggttggaaaagtgtagtattttggtgggagtgatttgattttttaggtgtgtttgttatttttttttttgatttggaaatggaattttttgattttttgtgttttttaagtgaggtaatgttttgttttgttttggtttgtgtatggtgtgtgtatttattgatttgtgtttattgtttggtattttttagtgagatgaatttggtattttagatggaaatgtagaaattatttgttttttatgttgtttatg

SEQ ID NO: 15442 - DNA, 204 bp, Artificial Sequence
  Description of Artificial Sequence: Synthetic polynucleotide
taaattagtaaatttaatattttaggatttttgttaagaagtttggttttggttgggaggatggagtttagtgggtagtggagttgttttagtttttgttgttgttttgtttgggagggaggtggggggggttagtttttttgtttggttagttgttttgtttgggaggtgaggggtgtttttgtttggttgtttttattggga

SEQ ID NO: 15443 - DNA, 228 bp, Artificial Sequence
  Description of Artificial Sequence: Synthetic polynucleotide
atttgggaagtataaggggttagggagtttttttttttggttaaggaaaggggtgatagatagtatgtggaaaattaggttttttttatttgaatattgtgttttttttatgggtttaaaaattggtgtattaggagattatattttgtatttggtttggagggttttatgtttatggagttttgttgattgttagtatagtagtttgagattaaattgtaaggtagt

SEQ ID NO: 15444 - DNA, 217 bp, Artificial Sequence
  Description of Artificial Sequence: Synthetic polynucleotide
tttagtggttgtaggggttgttgtgtgttttgtagatggatatgtgttatttaatatagagatgtgttgagtttgggtgattagtgaattgtatgttattgtagatattagaaagtgaaagtatatgggggaaggttttgggtatagatttagtatggttattatttgagttggagttgtttgtgagatgatgagtgtttgtaatttgtattttgtg

SEQ ID NO: 15445 - DNA, 201 bp, Artificial Sequence
  Description of Artificial Sequence: Synthetic polynucleotide
tttggtgtttaatttttgaattttaaggaaaaatagggtagaatagaaagtgaaataggtttgaaggtatttattgtgtggtaatattttagatgagtttgatggtatttattgtgtggtaatattttagatgaatatttaagatgtgtttggagttggttttttttagtgggtttgtggttttagtgattttaagaatga

SEQ ID NO: 15446 - DNA, 204 bp, Artificial Sequence
  Description of Artificial Sequence: Synthetic polynucleotide
atggtgtgtatatttattgatttgtgtttattgtttggtattttttagtgagatgaatttggtatttttgatggaaatgtagaaattatttattttttgtgttgtttatgttgggagttgtagattggagttgtttttatttggttattttggtttttttttggtattttttttattttttatttaggattagtttgttgtttt

SEQ ID NO: 15447 - DNA, 223 bp, Artificial Sequence
  Description of Artificial Sequence: Synthetic polynucleotide
tagaagtataagtaattgtttttttttgtattttagtggaatgttgtgggttttttgaagatttttttttgttttgtaggttttggtattttaagtatgtgagtttgtgtaggaggtgttttgttttttggagttttttattgttttttagatatagttttggttttttattttgggtggaggtttttttagatgggttttgattgtttttgtatgtttattg

SEQ ID NO: 15448 - DNA, 201 bp, Artificial Sequence
  Description of Artificial Sequence: Synthetic polynucleotide
tatttataaggttgaggtaggagaattgtttgaagttgggaggtggaggttgtaatgagttgagattatattattgtattttagtttgggtgataagagtgaaattttgtaataatattaataataataataaaataaaaataaaaataaaaaagaaaataagagatgtggtggttttgtttgtaattttagtattttggg

SEQ ID NO: 15449 - DNA, 203 bp, Artificial Sequence
  Description of Artificial Sequence: Synthetic polynucleotide
tttaatattaagttaggtttagggaagtgttttttttttttttttttttttttatttgagatgtagttttattttgttatttaggttggagtatagtggtgtgattttggtttattgtaagttttgttttttgggtttatgttattttgttgttttagttttttgagtagttgggattattgtttgattaatttatttgtatt

SEQ ID NO: 15450 - DNA, 201 bp, Artificial Sequence
  Description of Artificial Sequence: Synthetic polynucleotide
tataaaaagaattataaaatattgttgaaaaaaattagataatagttgggtgtggtgttttatgtttgtaattttagtagtttgggaggttgagttgggtggattatgaggttaggagatttagattattttggttaatatggtgaaattttggtgaaattttgtttttattaataatataaaaaaattagttgggtgtgg

SEQ ID NO: 15451 - DNA, 201 bp, Artificial Sequence
  Description of Artificial Sequence: Synthetic polynucleotide
attattgttaaaaattaaattgggttgggtgtggtggtttatgtttgtaattttagtattttggggggttgaggttggtggattatgaggttaggagattgagattattttggttaatatggtgaaattttatttttattaaaaatataaaaaattagttgggtgaggtggtaggtatttgtagttttagttatttgggag

SEQ ID NO: 15452 - DNA, 201 bp, Artificial Sequence
  Description of Artificial Sequence: Synthetic polynucleotide
tttgttttgattttgtttgtgggtgttgggatatttgggtgtagagggtttgtgtttagttagaagtgatttttgtttttttttgtgtaggtgttggtgtgtttgttgtgtgtgtgtggtttgtgtgttgttgttttggtttgtgtttttatatgtgtaggaaaggatatgttgtttgtttttatgttttttgtgattttt

SEQ ID NO: 15453 - DNA, 201 bp, Artificial Sequence
  Description of Artificial Sequence: Synthetic polynucleotide
gaggttgaggtaggagaattatgtgaatttggaaggtggagtttgtagtgagttgagattgtgttattgtattttagtttgggtgatagagtgagattttgttttaaaaaaaaaaaaaaaaaaaaaaaaagtgatttgggttgggtgtggtggtttatgtttgtaattttagtattttgggaggttgaggagggtagatta

SEQ ID NO: 15454 - DNA, 201 bp, Artificial Sequence
  Description of Artificial Sequence: Synthetic polynucleotide
tattagttaggtatggtagtatatgtttgtaattttagttatttgggaggttgaggtaggagaattgtttgaatttgggaggtggagattgtagtaagttgagtttgtgttattttattttagtttgggtaagagtgaaattttattgggaaaaaaaaatttatagtttaggttgggtgtggtggtttatgtttgtaattt

SEQ ID NO: 15455 - DNA, 201 bp, Artificial Sequence
  Description of Artificial Sequence: Synthetic polynucleotide
ggttagttttttgtttggttagttgttttatttgggaggtgaggggtgtttttgtttggttgtttttattgggaagtgaggagtttttttgtttggttatgattttgtttgggaggtgtgtttagtagtttattggggatgggttatgatgataatggtggttttgtggaatagaaaggtgggaagggtggggaaaaaatt

SEQ ID NO: 15456 - DNA, 201 bp, Artificial Sequence
  Description of Artificial Sequence: Synthetic polynucleotide
attggttaaagagtattgtgggtttttggaagtatttgtttttttattagttgtaaattggaatgataattagtttttaggttttggtttttgaatgtatgttgtgaatgatgtattgttttggttttatggtaggggttggggaggtttgttttattttgtattttgatttgggtttaaagttgagtttgaagggttttt

SEQ ID NO: 15457 - DNA, 201 bp, Artificial Sequence
  Description of Artificial Sequence: Synthetic polynucleotide
tttgttattatgtttggttaattttttgtatttttagtagagatggggttttattgttttagttgggatggttttgattttttgattttgtgatttgtttgttttggttttttaaagtgttgggattataggtgtgagttattgtatttggttttttttttttttttttttttttaagatagagttttattttgttgttta

SEQ ID NO: 15458 - DNA, 201 bp, Artificial Sequence
  Description of Artificial Sequence: Synthetic polynucleotide
attttggaaagtataggaggttatgttttagtgtggttttttttttttgggtttaagttaaggtttttattgtgtttgttggttttttgggtttttgtgtggtggattttggatttttttgttttgttttgttttagggtttttgtatttgttgttattgtggtttggaatgttttttttttgaaattttgtgatttttat

SEQ ID NO: 15459 - DNA, 201 bp, Artificial Sequence
  Description of Artificial Sequence: Synthetic polynucleotide
tgtgtttataagaatattagttattggatttagggtttatttaatttagtatgattttattttaatttgattatatttgaaaagatttttggttgggtgtggtggtttatgtttataattttattattttgggaggttgaggtaggtggattatttgaggttaggagtttgagattagtttggttaatatggggaaatttt

SEQ ID NO: 15460 - DNA, 211 bp, Artificial Sequence
  Description of Artificial Sequence: Synthetic polynucleotide
tttagtttttaggatgtgttttttatggttttttttgtggtgtggttatgtttggatttttttggtattttttatttgttttgtatgatttgttttgtgtgatttgttttgtaaggttggggggagtgttttttttttttgtgattttttatttttttttggtatttgtttattttgttgtttaggttttttgtttttttggttttagggc

SEQ ID NO: 15461 - DNA, 201 bp, Artificial Sequence
  Description of Artificial Sequence: Synthetic polynucleotide
gtgtgtgtatttattgatttgtgtttattgtttggtattttttagtgagatgaattgggtattttagatgtaaatgtagaaattatttgttttttttgttgtttatgttgggagttgtagattggagttgtttttatttggttattttggtttttttttttgaaaagagtattttttaattaagaagatggttttggttgt

SEQ ID NO: 15462 - DNA, 201 bp, Artificial Sequence
  Description of Artificial Sequence: Synthetic polynucleotide
atttagtggattttatattggggttgtaggtggagttgtttgttagttttgtgttgtgtgtttatattttttagtttttgggtggttgatgggattgggtgttgtggagtagggggtggtatttgtttgggaggtttgggtggtataggagtttatggagtgggtgggaggtttaggtatggtgggttgtaggttttgagt

SEQ ID NO: 15463 - DNA, 201 bp, Artificial Sequence
  Description of Artificial Sequence: Synthetic polynucleotide
gatatgtataggttatttaagagaatgattgatttttggttatttggtgtttgtttgttgtggtggtgttgtgttgggtttaggggttttagggatttttgttgtgttgttagttttggaattttagtggggatttgttgtgtggaaatttttggataatagttttttttatggagaatttatgtttttataatgttatta

SEQ ID NO: 15464 - DNA, 201 bp, Artificial Sequence
  Description of Artificial Sequence: Synthetic polynucleotide
ttatttttttatatttgtagagtgttttattttttgtaatgtttatttgtgaaattgttgtgttaggttaggagtattttaagagtgagaggtagatgttgtttgattttttattttgataggggatttttttatttggtagtgttaatatttggtttttatgtattttttatggaggattattaggttagtttatgggag

SEQ ID NO: 15465 - DNA, 201 bp, Artificial Sequence
  Description of Artificial Sequence: Synthetic polynucleotide
ttttggtagagttagtatttgattttttttgtttggagatttaggtgatggtgttgtgtgatttttgattttgtggatgaggaaggtagagagagagtgtgtagatatggaggttggtgttgaggttgagggagttatatttggttgtaagtttgagggagggaagttgggtgtggaaatagtttagtgggtttagaagtc

SEQ ID NO: 15466 - DNA, 201 bp, Artificial Sequence
  Description of Artificial Sequence: Synthetic polynucleotide
ttgttgttatgtttagttaattttttgtattgtttagtagagatggggttttattgtgttagttaggatggttttgattttttgattttgtgatttgtttgttttggttttttaaagtgttgggattataggtatgaattattgtatttggttaatttagtggttttgaggaggatttgttaggagttttgtaaaatgttt

SEQ ID NO: 15467 - DNA, 201 bp, Artificial Sequence
  Description of Artificial Sequence: Synthetic polynucleotide
attggatggatgtttgttgttgttttattggggttgtgtggggagttgagtgtgaggtttgtttggattttgagtttttggagtttgttagtttgtgtttgtgggggttgggttttgttagttgggattttttgtttggttgattattttataaaggtgtggttggggaaggggttaggtttttggaaggatggggagggg

SEQ ID NO: 15468 - DNA, 201 bp, Artificial Sequence
  Description of Artificial Sequence: Synthetic polynucleotide
ttataggtgtgagttatttggtttttttttttttttttttttttttttgagatgaagttttatttttgttttttaggttggagtgtaaaggtgtaattttggtttattataatttttattttttgggtttaggtaatttttttgttttaatttttggagtagttgggattataggtgtttgttattaggtttggttaattt

SEQ ID NO: 15469 - DNA, 201 bp, Artificial Sequence
  Description of Artificial Sequence: Synthetic polynucleotide
attatttggtttagtaggtagaggtgtaggaatatggggatggatagtagtatgtttatgttggttttggttattgagggtgtgtatgtgaaggttagttgtgttgtttatgtgaagtggtagtggttgggtattgggtgaatggtgtatattgttagttttagtgagatgaggaatatgtgtttgtaggttatggtgatg

SEQ ID NO: 15470 - DNA, 201 bp, Artificial Sequence
  Description of Artificial Sequence: Synthetic polynucleotide
gtagttttagttattttaaaggtagaggtgagaattgtttgaatttggaaggagtaggttttagtgagttgaggttatgttatttttttttagtttgggtgatagagaaagattttgtttagaaaaagtaaattatgggagttggtgttggtgagtgttgtttgggaggtagtggttggaggagtggatgggttttgtggg

SEQ ID NO: 15471 - DNA, 201 bp, Artificial Sequence
  Description of Artificial Sequence: Synthetic polynucleotide
gaggttgaggtaggagaatggtgtgaatttgggaggtggagtttgtagtgagttgagattttgttattgtattttagtttgggtgatagagtgagattttgttttaaaaaaaaaataaaaataaaaataaaataaaataaaaaatgagttgggtatgatggtataagtttgtggttttagttatttaggaggttgaggtgg

SEQ ID NO: 15472 - DNA, 201 bp, Artificial Sequence
  Description of Artificial Sequence: Synthetic polynucleotide
gtagtttaataattttgtgttgtaaatttaaatattttatatattattagatattaaaaataaagatttatgttgtttgtttttatggagtgaggattttgttgattttatatttggttatgaatttgtttgaggtttattagttgaatgtttttggttaagaaagtttgttgagtgggggtggtttttaaattattattt

SEQ ID NO: 15473 - DNA, 201 bp, Artificial Sequence
  Description of Artificial Sequence: Synthetic polynucleotide
gtgtattttggtttattataatttttattatatttgttttttttaggtttaagtgatttttttattttagtttttttagtagttgggattataggtgtatggtattatgattggttaatttttgtattttttgtagagatgggattttgttatgttatttaggttggttttgaatttttaagttaaagtaatttgtttgtt

SEQ ID NO: 15474 - DNA, 201 bp, Artificial Sequence
  Description of Artificial Sequence: Synthetic polynucleotide
ttttatttttattaaaaatataaaaaattagttaggtgtggtggtatgttttgtaattttagttatttgggaggttgaggtaggagaattgtttgaatgtgggttggggaggttgtggtgagttgagattgtattattgtattttagtttgggtgatagtgtaagattttattttaaaaaaaaaaaaaatttgttaattta

SEQ ID NO: 15475 - DNA, 201 bp, Artificial Sequence
  Description of Artificial Sequence: Synthetic polynucleotide
tatgtattatttatatgagtttttagtaggttttggttttaaataggtatatgtgtatttttttagttttttattgggatttttttgttaagttatgtttgatgtttttgtttatagttatgagttgtagtaagatgtttaggtttggtgttagtgtgtgtagtatgtgtgttagtattgtggaatttttgttgtttgagg

SEQ ID NO: 15476 - DNA, 201 bp, Artificial Sequence
  Description of Artificial Sequence: Synthetic polynucleotide
tggtattttggaaggttgatgtgggggtattatttgagattaggggtttgagattagttttgtgaatgtgatgaaattttgtttttattgaaaatttaatgattagttgggggtggtggtgtatgtttgtaattttagttatttaggaggttgaggtaggagaattgtttgaatttggaaggtggaagttgtaatgagttg

SEQ ID NO: 15477 - DNA, 201 bp, Artificial Sequence
  Description of Artificial Sequence: Synthetic polynucleotide
ttgaggtgggttgggtgtggtggtttatgtttgtaattttaatattttgggaggttgaggggggtggattatttgaggtgggtttggtgtggtggtttatgtttgtaattttaatattttgggaggttgagaggggtggattatttgaggtgggttgggtgtggtggtttatgtttgtaattttaatattttgggaggttg

SEQ ID NO: 15478 - DNA, 201 bp, Artificial Sequence
  Description of Artificial Sequence: Synthetic polynucleotide
ggggttttggttaggggtgggtgaggttggtgtttttttaggttttttttagttataggtagtaggtgttatgggagttttgttggtattttttttttttgttagggttttggtttatttgatggtgtagtttttttttaaggtgtgtattggtgtagatattgtgtaggaagttaggttgatgtagatggtttttaagtc

SEQ ID NO: 15479 - DNA, 201 bp, Artificial Sequence
  Description of Artificial Sequence: Synthetic polynucleotide
aaagttgtttaaagttttataatgagttgatttattgggaataggaggaggttttgttgttagtttttgtgttatatttggtattttgtttaggtttattggagaggagattatatgttttttttttagtttttttaatttttttagttaagataggtgttattatttattttagttttagtgtgttttgagtgtgttgga

SEQ ID NO: 15480 - DNA, 201 bp, Artificial Sequence
  Description of Artificial Sequence: Synthetic polynucleotide
tatttttttgttttagttttttgagtagttgggattataggtgtttgttattgtgtttggttaattttttgtatttttttagtagagatggggttttattgtggttttgattttttgattttgtgatttgtttattttggttttttaaagtgttgggattataggtgtgagttattgtgtttggttgtgtgtgttttttaa

SEQ ID NO: 15481 - DNA, 201 bp, Artificial Sequence
  Description of Artificial Sequence: Synthetic polynucleotide
gtatgtggtagtaggatttatttttggggtgttttgggttggtgaatttatatttttttatgttaatggtttgtagtatttgtagtttgtgggttgagttggttgtggggggtttattggtggtaggggtattattggggagagtggtggatggttgggttggtggtggtggaggtagtaggggttttgttatgtggttgt

SEQ ID NO: 15482 - DNA, 279 bp, Artificial Sequence
  Description of Artificial Sequence: Synthetic polynucleotide
ggtggaagagttgatagtaaggggagtggttaaatggaggtggggtttggaagggggtgtggtttgtgggtttttgggttgtttggtttttttaggtgttgtagtggaaggtttggagtagaggttgtttttttgtttaagtattttttgggtgagtttatatttttggtgtgagtatgatttttttttttagggaaggttgggttttttgttggggtttgatttgattttttttttttatttttttttttttgttttatatttagtgagtttaggttt

SEQ ID NO: 15483 - DNA, 201 bp, Artificial Sequence
  Description of Artificial Sequence: Synthetic polynucleotide
ttatatgggaggttgaggttagagaatggtgtgaatttgggaggtagagtttgtagtgagttgagatggtattattgtattttagtttgggtgatagagtgagatttagttttaaaaaaaaaaaaaaaaaaaaaggaaaatttaggtttttttttagattgaaatttttgtaaatataatttatgattttatagtagttag

SEQ ID NO: 15484 - DNA, 201 bp, Artificial Sequence
  Description of Artificial Sequence: Synthetic polynucleotide
ttttgttgtaaaagaagtgtttatagaatttttatttttttttattattattattttttgagatagagttgttgttgtttgggttggagtatagtggtatgattttggttaattgtaagttttgttttttgggtttatgttatttttttgttttagttttatttttttgttttgttttgttttgttttgttttgtttttga

SEQ ID NO: 15485 - DNA, 201 bp, Artificial Sequence
  Description of Artificial Sequence: Synthetic polynucleotide
gtttttttaatattttgaaatttaaagtgtgatagttttagaggattattaatataagtattatttgaaaatttgttagaaatgaagaattaggttgggtgtggtggtttatgtttataattttagtattttgggaggtttagatgggaggattatgatattaggagattgagattattttggttaatatggtgagatttc

SEQ ID NO: 15486 - DNA, 201 bp, Artificial Sequence
  Description of Artificial Sequence: Synthetic polynucleotide
tatggtgaaaatttgttttttttaaaaatataaaaattagttaggtgtagtggtatgtgtttgtagatttagttatttgggtggttgaggtaggagaattgttggaatttgggaggttgaggttgtagtgagttgagattgtattattgtattgtagtttgggtgatagaataagattttaatttaaaaataataataata

SEQ ID NO: 15487 - DNA, 201 bp, Artificial Sequence
  Description of Artificial Sequence: Synthetic polynucleotide
tttgtttaggaaatgtatataggagttggttattttgtgttttgagtttttttggaggtgttggatttttagagagagaaatagagatatgtaagagggtgaagatgttttagtggtgatatattggggagttttgtttatgatttgtttatgattggtatatttaatttgttttatggaattttattttatagtttggtt

SEQ ID NO: 15488 - DNA, 201 bp, Artificial Sequence
  Description of Artificial Sequence: Synthetic polynucleotide
tgttaggataagtgagggtggtttgagttttgtgtttatatggtgtatgttgtttagtagatgatattgatggttgtaaatgttgtagggaatatagtgtgggtgtaaatgttaatggtgtttgtgttgatgggtttgagttgggtatggatgtttttttggttttttgagtgggttgttttttttttttttgtttttttt

SEQ ID NO: 15489 - DNA, 201 bp, Artificial Sequence
  Description of Artificial Sequence: Synthetic polynucleotide
tttttgttgagagtggattttgtgtgtgtgttttttaggaatggtgataagtatgatggtgattgggtttgggattggtgttagggatatggggtgttgtgttgtgttgatggttttatttataaggtatttgggggtgtgtggtatttgttgtttagagggtataggttttgtggtgggtagggtgtgtggggtgtatgg

SEQ ID NO: 15490 - DNA, 201 bp, Artificial Sequence
  Description of Artificial Sequence: Synthetic polynucleotide
gatattatattttatatttttttattttttttgatttggagttttgttttgttgtttaggtttgggtgtagtagtgtgattttggtttattgtaagttttgttttttgggtttatattatttttttgttttagttttttgagtagttgggattataggtgtttgttattatgtttggttaattttttgtatttgtagtaga

SEQ ID NO: 15491 - DNA, 201 bp, Artificial Sequence
  Description of Artificial Sequence: Synthetic polynucleotide
tttttttttagaaagtatatgaataggttgggtatggtggtttatgtttgtaattttagtattttgggaggttgaggtgggtggattatgttagaagattgagattattttggttaatatggtgaaattttgtttttattaaaaatataaaaaaaaataagttgggtgtggtagtgggtgtttgtggttttagttattttg

SEQ ID NO: 15492 - DNA, 201 bp, Artificial Sequence
  Description of Artificial Sequence: Synthetic polynucleotide
gtgtgagagttatatgttaggaataagaggtatgttgagaggtggttgggtatggtggtttatgtttgtaattttagtattttaggaggatgaggtgggtggattataaggttaggagattgagattattttggttaatatggtgaaattttgtttttattaaaaatataaaaaattagttgggtgtggtggtgggtgttt

SEQ ID NO: 15493 - DNA, 203 bp, Artificial Sequence
  Description of Artificial Sequence: Synthetic polynucleotide
ttttataatgttttttattatttgtgagtatggtttgtaatgtggaagatataattttatttgattttttttagatttttttgttgttttagttttttatgtgttagtttttgggtttttattttaaatttttttaggtttagaatgttttgttttaaattttattgatattatttgtgaaattgtagttttttatgattaat

SEQ ID NO: 15494 - DNA, 201 bp, Artificial Sequence
  Description of Artificial Sequence: Synthetic polynucleotide
attatatatggttgggtgtgatggtttatgttattgagtgattgttgtaattttagtattttgggaggttgagatgggaggattatgaggttaggagattgagattattttggttaatatggtgaaattttgtttttattaaaaaaataaaaatattagttgggtgtggtggtgggtgtttgtagttttagttatttggga

SEQ ID NO: 15495 - DNA, 201 bp, Artificial Sequence
  Description of Artificial Sequence: Synthetic polynucleotide
agttttagttatttgggaggttgaggtaggagaatggtgtgaatttgggaggtggagtttgtagtgagttgagattgtgttattgtattttagtttgggtgatagagtgagattttgttttaaaaaataaaaataaataataataataattttagatattttataataatttttaggtataagagtttttatgagagtagg

SEQ ID NO: 15496 - DNA, 201 bp, Artificial Sequence
  Description of Artificial Sequence: Synthetic polynucleotide
tgggggttttagaatttttgtagtttatatttttttggtttttttttgggtagtttggaggtttttgattttttggagtttttggtatttgagtttttttgtgaaagtttgtttgagaagggtttttgttttgggtttggtagattggagtttttttttgggttttttttttttttttttgggtgttttgttttttgttaa

SEQ ID NO: 15497 - DNA, 201 bp, Artificial Sequence
  Description of Artificial Sequence: Synthetic polynucleotide
atgtgttattatgtttggttaatttttgtatttttagtggagatggggttttattatgttggttaggttggttttaaattttttattttgtgatttgtttgttttggttttttaaagtgttgggattataggagtgagttattatgtttggttttaattttagttttatagatgaaaaaatggaagtttaggattagtgat

SEQ ID NO: 15498 - DNA, 201 bp, Artificial Sequence
  Description of Artificial Sequence: Synthetic polynucleotide
aagtagtatttggttttttgtttttgtgttaatttattttggataatggtttttagttgtatttatgttgttgtaaaggattggattttgttttttttatgattgtatagtattttatggtatatatatatatatattatatttttttaatttggtttatttatgtttttgttgttgtgaatagttttgtaatgaatatgt

SEQ ID NO: 15499 - DNA, 201 bp, Artificial Sequence
  Description of Artificial Sequence: Synthetic polynucleotide
ttaaataaatgttgggtgttagggttgttgagtaagataataggttgtaaggatgtagtagaggatttttggttgatttgttgtgatggagtgagttagtggtgaggtttgaaggtttttgttttattttttttttggagtagaggttggggagggtgttgggtgttagtatagagtagagggttggttatggaattgggg

SEQ ID NO: 15500 - DNA, 201 bp, Artificial Sequence
  Description of Artificial Sequence: Synthetic polynucleotide
gggagtgtagtggtgtgattttggtttattgtaatttttgttttttgggtttaagtgatttttttgttttagtttttttagtaggtaggattatagttgtgtgttattatatttggttaattttttgtatttttagtagagattgggttttattatgttagttagaatggttttaatttattgattttgtgatttgtttgt

SEQ ID NO: 15501 - DNA, 201 bp, Artificial Sequence
  Description of Artificial Sequence: Synthetic polynucleotide
ttagtagaaatagggttttattatgttggttagaatggttttgattttttgattttgtgatttgtttgttttgtttttttaaagtgttgggattataggtgtgagttattgtgttttgtttattgtttatttttttttgtttgttttattttgattgttggggttttggatattatataaagagttagttggagagtgaga

SEQ ID NO: 15502 - DNA, 201 bp, Artificial Sequence
  Description of Artificial Sequence: Synthetic polynucleotide
ggaatgtagtggtgttattttgttgattgtattttttgttttttggttgtaagtgatttttttgttttagtttttttagtagttgggattataggtgtgtgttataatatttagttaatttttgtatttttagtagagatgggtttttattaagttggttaggttggttttgaatttttgattttgtgatttgtttgtttt

SEQ ID NO: 15503 - DNA, 201 bp, Artificial Sequence
  Description of Artificial Sequence: Synthetic polynucleotide
tattttggttttttaaagtgttggtgttataggtgtgaattattgtatttggtttgttttttattttattatttatttattttttttgagattgagttttgtttttgttgtttaggttggagtgtgtagtggtttaattttggtttattgtaaattttgttttttgggtttaagtgatttttttgttttagttttttgagt

SEQ ID NO: 15504 - DNA, 3238 bp, Artificial Sequence
  Description of Artificial Sequence: Synthetic polynucleotide
tttttttttggattggtttaatttttttttttaagtttggtattttgtttttttttagtgggggatattttgttgttttggggtgtttgttgtgggtgttgtatgattttgggtgtaagttagagattttataaatatgttgggttttgtgtagtggtttttgggaaggtattgttatttgtgggagggtttggtttgttattttttattttttgttgttttaatgttattttttaagtttggtgtttttttttttttttttggaggtttttgtgttgttttggggtgttttttgtgggtgagatatataatttgggtgtaagttagggattttgtgattatttttggtttggtgtaggggtggttatttttgggatgatattattttgttatttttttttttggattgtttttattattttttttaattttggtgttttgtattttttttttagtggtttttttgttgttttgtggtgttttttgtgggtgagatatgtatttggggtgtaagatagggattttaggatgtttttgggtttattgtagaggttgttgggaaggtagtgttgtttgtgagaggattttagtatttttgttttttttttttggggttgttttaatttttttttttaagattgatgtgttgttttttttttttgggaatttttttgttgttttgtggtgtttgttgtgggtaagatatttattttgggtgtaagttagggaattaataatttttgtatgtttggtaaaggggttgttggtaaggtattgttatttgtgggattattttagttttgttgtttttttttttaggttatttaaatgtttttatttaagtttggtgttttgttgtttttttgtgggggattttttgttattttggggtgttttttgtgggtgagatatgtatattgtgtgtaagatagggattttgtgatttttttgggattggtataggggttgtagggaaggtattgttatttgtgaaaggattttagttttgttttttttttttttgggttgttttaatgtttttttttaagtttggtattttgtttttttttttttggggtttttttgttgttttggggtgttatttgtgggtgaggtatgtattttgggtgtaaattagggattttaagatttttagggttaggtgtaggggatgttgggaagttattgttttttgtggaaagtttttttttggattgttttaaagtttttttttaagtttggtattttgttttttttttttggagttttttttgtagtttttgtgtgtatatttaggtgagatatgtattttgttgtaagatagggattttaaatttttttgtttgggttaggtttaggggttgttgggaaggtattgtggtttgtgggatgattatagtttagttgttgtttttttttggttggtttaatgtttttttttaagtttgatatgttgttttttttttttgggggttttgttgttatttttatgtgtattttgtgagtaagataggtattttgggtttaagttaggggttttattgtttatttgggttttatttagaggttgttgggaaggtattgtttttagtggaaattttttttttggattgttttaatgtttttttttaagtttggtgttttgtttttttttatttggggattttttattgtattgtggtgtttattgtgggtatgatatgtattttgggtgtaagttagggattttataattattttaggtttgatgtaggggttattggataagatattgttgtttttgggatgatattggtttgttttaattttattttttaattttggagttttgtattttttttttgggggtttttttgttgttttgtggtgttatttgtgggtgagatatataatttgggagtaagttagagattttatgatatttttgggtttattgtagaggttgttaggaaggtggtgttatttgtgggaggattttagttttattatttttattttggggttgttttaattttttttttaagtttgatgtgttttttttttttttgggaatttatttgttgttttggggtgtttttttgagtgagatatgtattttgggtgtaagttatggattttaggattattttggtttagtgaaggggttgttaggaaggtattgttgtttgtgggagaaatttagtgttgttgtttttttttatgggttattttaaagtttttttttaagtttgaggtgttgttttttttttttaggggtttatttgttgttttggggtgttttttatgggtgaaatatgtattttgggtgtaagatagggattttatgatttttttgggtttagtgtagggattgttaggaaggtattgttatttgtaggaggaatttgattagttgtttttttttttgtgttgttttagtatttttattaaagtttggttttttgtggtgtttgtttggtggtttttttgttattttggggtgtttttatgggtgtgatttgtatttttggtgtaagttagggattttatgattattttgggtttgatgtaggggttgttgggaaggtattgttgtttatgggatgattttagtttgttatgtttttttttggattgttttaattattttttttaattttggtgttttatattttttttttggtggtttttttgttgttttgtggtgttttttgagggtgagatatgtattttgggtgtaagttaaggattttatgatgtttttaggtttattatagatgttgttgggaagatagtgttatttgtggtaggattttagtattttttttttatttttggggttgttttaatgtttttttttaagtttgatgtgttgttttttttttttgggaatttatttgttgttttggggtgttttttgtggaattttgggtgtaagtttgggatataataatttttttgggtttggtaaaggggttgttgggaaggtattgtggtttgtgggaagtttttttttggattgttttaaagtttttttttaagtttggtgttttgttttttttttagggggtatttttgttgttttggggtgtttttttgtgggtgtgatatgtattttgggtttaagttaggaattttatgataattttgagtttggtgtaggggttgttgggaaggtattgttgtttgtgtgatgattgttgtttgttgtttttttttttgtgttgttttaatgttattttttatgtttggtgtttta

SEQ ID NO: 15505 - DNA, 201 bp, Artificial Sequence
  Description of Artificial Sequence: Synthetic polynucleotide
tgttattttgtttggttaattttgtgtgtgtgtgtttttagtagagatggggttttattgtgttagttaggatggttttgattttttgattttgtgatttgttttttttggttttttaaagtgttgggattataggtgtgagttattgtgtttggttttttgtatattattttttgagatattttgaggtaatagttttgg

SEQ ID NO: 15506 - DNA, 201 bp, Artificial Sequence
  Description of Artificial Sequence: Synthetic polynucleotide
tgatgtttaagtatttgagaatggtgattaattattttggagagtatttgtaaaggtggttttttagttgttttttttggaagttgtagtttttgtgtttgtttttgtattttgtatatttgttgaggtggggtgtgttaattattaaattattaatgagtgatggtttaaattgtaggtagagtaatgaatagatggtgg

SEQ ID NO: 15507 - DNA, 201 bp, Artificial Sequence
  Description of Artificial Sequence: Synthetic polynucleotide
tgtaataagtttgggggttgattttgggtgtgttgggggtgagggggttatggtggagatggatatgggtgtggggtggttgagatttgtatggtttagtgggtattggtattgtggggtttttgtttttagaggattattgttttatattgaagtttttttttttgtatatttagagtttgatgtatttttaattattgt

SEQ ID NO: 15508 - DNA, 201 bp, Artificial Sequence
  Description of Artificial Sequence: Synthetic polynucleotide
gggtgtggtggtgggtatttgtaattttagttatttgggaggttgaggtaggagaatggtgtgaatttgggaggtggagtttgtagtgagttgagattgtgttattgtattttagtttgggtgatagagtgagattttgttttaaaaaaaaaaaaaaaaaaaaagaagaagttagagtaaggaggtagaatgatttttagg

SEQ ID NO: 15509 - DNA, 201 bp, Artificial Sequence
  Description of Artificial Sequence: Synthetic polynucleotide
ggttagggtgtatgtggtgttggggtttggggggatgtttgttgttttggttgtattttggttatgtatatttttgggggtggttgttttattgtagggtgtgggggtggagtttggtttaagaagagtggtaaagggtgggtggttttggtggtttagtttagggtttgggagtgtttgggggtttttttgttttggggg

SEQ ID NO: 15510 - DNA, 201 bp, Artificial Sequence
  Description of Artificial Sequence: Synthetic polynucleotide
aaaaagtaaaaaataaaaattagttggttatagtggtgggtgtttgtaattttaattgtttgggaggttgagttaggataatagtttgattttgtggggtggaggttgttatgagttaaaattgtgttattttattttaggttgggtgtaagagtgagattttgttttaaaaaaaaaaaaaaagttttatgttgggtgttg

SEQ ID NO: 15511 - DNA, 201 bp, Artificial Sequence
  Description of Artificial Sequence: Synthetic polynucleotide
taggtgtgagttattgtgtttggttatttttgataattttattttaaatagtgataggttaaaagttaagagtggatgttttagtatttagttttttagtgttttgttagttattttaagtttgttgataggagtttgattttattgattttttttttttttagagttatgtttattttttaaaattttaagaagttgttt

SEQ ID NO: 15512 - DNA, 201 bp, Artificial Sequence
  Description of Artificial Sequence: Synthetic polynucleotide
attttggaggttgaggtaggagaatggtgtgaatgtgggaggtggagtttgtagtgagttgagattgtgttttttgattttaggtgatttgtttgtttttgtatttggttaatttgtttttgtatatataatttttttattgtttaatatattttagggttttttaattttatattttatattttagtttttttaatagat

SEQ ID NO: 15513 - DNA, 201 bp, Artificial Sequence
  Description of Artificial Sequence: Synthetic polynucleotide
tagggttttgttgtgttggttgggttggtttttagtttttaattgtgagtgatttgttaattttggttttttgaggtgttgggattgtagatggagttttgtttatttagtgtttaatggtgtttaggttggagtgtagtggtgtgattttggtttattataatttatattttttagttgtttgttttggttttttaaaat

SEQ ID NO: 15514 - DNA, 201 bp, Artificial Sequence
  Description of Artificial Sequence: Synthetic polynucleotide
aggttgaggtaggtggattataaggttagaatattgagattattttgggtagtatgatgaaattttgtttttattaaaaaatataaaaaattagttgggtgtggtggttggtgtttgtagtattagttgtttaggaggttgaggtaggagaatggtatgaatttgggaggtggagtttgtagtgagttgagattgtgttat

SEQ ID NO: 15515 - DNA, 414 bp, Homo sapiens
ccgccagtgtccgtcgccttccacacgtggccgcagttctgtgcatggggccgcccgccatcctgccgcctctgacctgggctgtgggctcgtgacacgtgtctgagctttccagtcgtggccgtgacgctctgtgcggaggctccgtccgcgtgctgcctccgtcccctctgccctggacggccactcactacctttgtctctcaccctgggggtttcatgaccccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacg

SEQ ID NO: 15516 - DNA, 987 bp, Homo sapiens
ccggagggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggtgggtcagtccagtcctgagggcgcgggctcctcg

SEQ ID NO: 15517 - DNA, 1061 bp, Homo sapiens
tcgctgttggtggggcccggggagccctgctgtggccgccactcaccaggtaggcggtgaaggcctcggcgtcggcatccaccagcgtggttagcttggccgaagcctcgcggaagggcgggatcaggcgccgcatcgtcgtgtccagggactggaattggcgccgcccgtaggtcatgaggcccaccatggagcccagcgccgcaccctgcgagaggggtggatgtgggggtcgcagggaccccagacggcccgggaccgaccccaggaagagccaggggcccgggtgatccctgcgggggtcccacccgtgtggcccccacgtctccacccagggcggccccaccgcgccctccccaccccgtgccctccccccaacagcgcccttccccctccccgccctccccccaacaactgcgcctcccctgcccctccccccgcgctcaccatggccgcagcggccgccgccaccgagccgcccccgggggccgcagagcgggcacccacctcccccacgaaggcgcgcagggacttgctgcccaggcctcgctcaggcccgcgctcagggaccaggtacctgcagggtgggcgcggctcagcgggtctggccggggttggtggggggagcgcagtcctcccggggcggccccaggccccacgcccgtctgcacccacggggaggtgaccactcggctgagaacctgcggggacccggccggggtctctgtgcccccctcagcccccagaccccggcttggcgcaggccgagtaggcgcccaaagggaggcgctgggaggactcagccgggtctccacgcagggaccccagcgccccgcaaggcccgagaggcagagcccgggaggggtgagaagagggcgggagggcagaggctcactcgatgatccgctccttagggctgaaggggcacagggagtccaggcccagccggctcaccacctggaaaaggggcttggagtggaaacggcctcggcgcgtctccaccaccaggaaagcctcggaacccgcgggtcccacccttgcggcagccgccccctgccccg

SEQ ID NO: 15518 - DNA, 382 bp, Homo sapiens
gcgtgtttatcatccggcacacgggagacccacgcgtgtttactgtcgggcacaggggagacccacgcgtgtttactgttcggcacacgagagacccacgcgtgtttaccgtttggcacagggagacccacgcgtgtttactgtccggcacaggggagacccacgcgtgtttactgtccggcacagggagacccacgcgtgtttactgtccggcacaggggagacccacgtgtgtttactgtccggcacagggaagacccacgtgtgtttactgtccggcacacaggagacccacacggggcctgtttaccatccggcacacaggaggcccatgcatctttaccgtcaggcacacgggaaacccacgcgtgtttaccgtccg

SEQ ID NO: 15519 - DNA, 261 bp, Homo sapiens
acggaggacttttcgcccctgcggtcagctggaccaggtggccggcagcgagacggaacaagtagaccaggctgagggtgaaggcgcaggcgatcagcagcatggacaagaggttgccgcctgccacctcctccatcgcctggcccagcacctacccacccgcctgtagcaagcccagcagcatcatcccggccgccgccgccatttcactctgtcggagacactgaaggccgaggtcgccaccgatcctcctaatcgacg

SEQ ID NO: 15520 - DNA, 892 bp, Homo sapiens
acgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctcgtggccaaggcaggattagggcggcaggagaagcgcgagaaggaggagcagacgcacagcgacccagcccggcctccgccaacgcttaaacagccccgcg

SEQ ID NO: 15521 - DNA, 682 bp, Homo sapiens
ccgggggcccacggtgtagcgggtcgtcagccgggccccgggccttctgggcagcaagggccctggcaggaccctgagggctgggccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcg

SEQ ID NO: 15522 - DNA, 223 bp, Homo sapiens
acgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcggggccgggaccagacctgtgcatctctccgcctcgcacccagcgcctctgtttttcg

SEQ ID NO: 15523 - DNA, 255 bp, Homo sapiens
gcggacagctcgaatgtactgcagaagcatccgcccatcagtgggttccatcgccgggcacaggcctgtgtgcccagggcagagcgcctggtgcatgctgtggagggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccg

SEQ ID NO: 15524 - DNA, 309 bp, Homo sapiens
ccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccg

SEQ ID NO: 15525 - DNA, 992 bp, Homo sapiens
ccgccctgcgctcagcagcacagcaccgtgggggtcagatagaggcgctcccgcctcccagccggggccagctccgggccccctcttcccccagaccggcacaggacccagaccgcccaccccagcacactgacccagacagtctcgcggatcagcctggctatcttgagcaggagctgcccgaatgtgcccggctggaagtgggtggccgagtgctggatgcagaggcacaggaggaaggcgggggtcagcttgtggtcgtcgccccccggctcgatcaacgtcatgatcctctgcagcagcgtgtcctccaggtggggctcaaactccaggagcagctgctggcgccggggcagggcggcctgagtaggggaggcggctccccgggccccgagcgcggccccgcacagccggcagctctgcggcacagcccggaggcgcgccaaggcccgggcgggcaggggctgggcctgcgcggggtccttgaatagcagcaggtagtagagccccagggagagcaggtccccgtggtgcagcaccacggtcctgtgccccacctcggagaagttgacggagatgtgcgccccggggatgggctccaggaccagcctccccgcggcctggccgctgtccgggagcggttgccggcggatggtgcagtgtagaggcaggatgtcgggggctgagaggctgatgctgggcttgctggagggggtccgctggcccaccgtgtgccggtcccggttgagcacatacaccaggctgtcctgaaacagagactccgctcagggcaggcgtaacgcgagcagcacacgggaaaagcgtcccgtgtctagtcactggttgctgaagcagcgtggctgggatgctgtcgccacgggctctccatgtccctggccacccccacaccagaaccccgacggctctcaggaacccgcccctcgatgtccgggcccatcccagaggaggtcggtttcccggaggagcacacg

SEQ ID NO: 15526 - DNA, 265 bp, Homo sapiens
ccgcgtcctgcgctcctggttttctcctcttctagtgtcttccccacctggcgtcgcccggccgcaaccctggccctcctggggaagaggttcggaccctactctttatttgacatgaagaggttcggactcccagttttattcggcatgttcacgggcagcagccccattttgtttggcgtgttcacgggcagcagccctgttttattcggcgtgttcacggtcagcagccccgttgtgcttggcgtgttcacgggcagccccg

SEQ ID NO: 15527 - DNA, 488 bp, Homo sapiens
ccggcggaggcgggcgtggtgggggaggggctctctcttttgcccttttacccctctggtaggcgccctagggcgggggtgctgccgcgcgcttcggcgcgccttggttctgtcaccagccccactggggcctcacaatcgctcagccgtccagtgcgcgcctggagaaagagaagtgggcgactacggagcagcgtctccattactgaccgttttctcgccattgtacccacacaacttgctctaaatgggcaatttattaagtatattttgtccctgttcccgccgcaggcccctgccggaccgtcgcccacaagctcccatagcccgtgagtcctctcagcctggcccggctcaccctgtggcgcccacgtctaccccgggccctttccgattcctctttaaccctcagcagagtcgcgggccttctccagtcagcttctacagcgcgcctaggagaccgtgtcctctcccgccagacacgggcg

SEQ ID NO: 15528 - DNA, 676 bp, Homo sapiens
ccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcg

SEQ ID NO: 15529 - DNA, 1238 bp, Homo sapiens
gcggcccaaaggcaccggacgttggggccaagatgacctccgcgctgccatgaaccaggccattggacgcgggctccgcgccgagcctgcagtcctcgaggagtctctcgggttcctccgttttgatcacaccttctcggatggctgccgggcttttgcctgccccgccttgcatcgagtctctcatgacctcctccgcctccagcttgcccttctcgtcccctcggaagtagccgagggccggcccggggccttccaacttgaccaccctggaggctctaggaccggtttcgacggcccctcgaggccccactgactgatccaggctgggccccagcttctgcttcttggccttgacatgcagcgccaggggctgcaccgggtgcaactcgggcctggaggtggcgccgtctgacgctgtcggcggctgcaggagccgcaggtcgggcctgaactgcaacagccgcgcctgcgcggacgaggcagcggcttcctcgttctgggcctgaggctgtggtagcagcaacacctgctctggcttcacctgcagcagccgccgcaccgcgggctgtaagccggacgccactgcctccccgcacgacgaggccaaggtcgcactggctgccgcgctcagtgtgggagacgacggagggggctccatggctgctgcccaaaaggaggtgccctcgaccggcagcgggggcggagcgggacgcaacgggcgcggctgaggcggcggctcgggtctggctctctccatgggggagggggacgccccggccaggattgtgagctcagccgtttgttggcgaccttccccctccccctttcggttaagagccttgcaaggcctttgctacccagaaccctacgcggttcaaaacgcagctgtctgtctgggcctcacccaatcacaacgaccgatacccgtggacggccaatcacaggcgggttttccggctcttcctggtccctactctcgcctcgtgctgagtcctcgaatcacctgccatggtaggagccgccgcacttgttgcacattttcgttctgactctcttgtggagttctcttacagccgttgtctttagtcatccctcccccacccggagctgcgacaatggcgttgcccaggaaacgttgcgcttccaggccgctgacatccagggaatgaagtcttgcgtcacaaggggagcgacggccttgtgcacgcgctctgtgcggcctgagtaatctgtcg

SEQ ID NO: 15530 - DNA, 220 bp, Homo sapiens
acgctcatcgtctcgcaggcagctccagctcgagtggtggccgtgctgggtctgtgcccggggccttcccccgtatgctttcgctttctagtgtctgcgatgacgtgcgattcactaatcacccggactcagcgcatctctatgttaaatagcgcgtgtccatctgcaaagcacacgacagcccctgcggccactgggtgccggcgcccagcctgtcccg

SEQ ID NO: 15531 - DNA, 631 bp, Homo sapiens
gcggtgaggggtgatttcggaggaggcagagccccgggtgtccgtgggaagctccaaagccgggccgcgggacggctaccctgggctgtgacgcagtccaggatcttcgccaaggcacctgctggaggcccctcctgggtcccacgaccccgactgcgcctgccggctgccagcgaggaggcggggccaaggcgagggcggggccgaggcaggaggggcggggtcggcctgatgggcggggcttccgtgtgggcggggctgctggccctgcggtctgagccagcggggagaggcccgggcggaggaggctgcggactcctagaggttcagtgccggaagttgggcctggaaagggggcaccgccttcccggttctggtggcggggagtgaggggacgggcgaaagcggcacagggaacagcatgacacgggcctgaggcagggcacatttggaaaggggcgaggagagggcagtggcttctggcacggcagcagtgggcatacagaggcagtcgggacccgtctggaagagcctccgcccggggtaaggagccgggactgtgtctaggaggcagtggggagctccggagagcgaagcgcctcctgcgcagactcgcgtgcttggagtaccg

SEQ ID NO: 15532 - DNA, 904 bp, Homo sapiens
acggcgtctgcctctcgctcttggagtgctcctggcctaacgcagcagtttcgcagataaacgttacagaaggtagagcgctctacagatatgaaggagtggcccgtggtttcacgtagaacaaattacttccggcagaaagatcaggaaagtttcgaaatcgcggagttctcaagggatgggcagaacgggcgggtgagcagggccaagcgcctcctggacagtgaccatcccggagcctggggacgcgctggggggcaggagctgtcccactcgttcaggcgagggtctgggaagggaccccaagcgggaggccgacgctgcctgggtcctcccttggggcggccgcctccccattcaccccgagcatcccgaaacctggaaaggagcaaagctgaagcgatggccacgtgcatgacggcaggcagcctgcagattcgttgttaaactacactcacgccgggtctaacaggcgcgcacctgccggcacgccgcccgctgctgtgacctgggcagcgtcgggtctcaggcccccgcctctcgcgctgtgacagtgagaagccgagaaagtcatgtcacgtccgtctgaggaggcagctcctcagtgtggcagaaagaaatgcccactctccgagcaccagccaggacgtgtgcttaagccaacctgttcattcttccacctgatcccttatgtaatgtaacatgcatgtttcatccacaaaaatgagcagcgaaatccaccgacccagcaacatgttccgagacacgcaggagccttttccacggagccagctcccggccttcccctccaacatccaccccgcgctcgcgtagcccgggctcctgccattgcgctgccagctgggcggcacctttcaggcggggaaaagcgaatcttctgccg

SEQ ID NO: 15533 - DNA, 519 bp, Homo sapiens
acgtcactctctgggggcgcggtggggctgggcagggagcgcggcgcgtgtctgacacccatggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtgcgaccgccg

SEQ ID NO: 15534 - DNA, 204 bp, Homo sapiens
ccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagaggtaagtcctgctgccacgtgcctccccacgggcctgcgtctgcacctccctgcgcg

SEQ ID NO: 15535 - DNA, 444 bp, Homo sapiens
ccggccttcgtgcagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacg

SEQ ID NO: 15536 - DNA, 397 bp, Homo sapiens
acgcgccctgcccaccacgaggcctgtaccctctgggcagcaggtgccgcgcgcccccgggtaccttgtaggtggagccgtcggcgcagcgcagcaccccgtgtccctgacgccggtcccggacccagtcgccgtcgtacttgtcaccgttcctgggggacacacgcacggagtccactctcaacagggggagccgggtggtggcagtgactcagaccggctcctcccaccgggctccgcaggcactgcgggaccgaggcaaaaataggcccgagcagatggccccaagagctcctgcctcgccagggccagctgggggccgacgacaggcggtggggacacgtccgcccacccccaccctagatggtaggcctgctcgggacgcactcagcttccg

SEQ ID NO: 15537 - DNA, 1530 bp, Homo sapiens
acgcatggaatcttcgagcctggagaacgtgctggagccctgcgcctacgcccccacctacgtggtcaaggacttcccgatcgccagataccagggcctgcaatttgtgagtgcggctggagaccccgtctcccgtccgggactccgcggagccttctccagccccttgggaggccgccccgggaggtccgcgccctgagccctgcgcccccccaccccccaggtgtacctgtccttcgtttatcccaacgactacactcgcctcacccacatggagacggacaacaagtgcttctaccgcgagtctccgctgtatctggagaggtgggcgcgcggccgggctaatgcggggcggggtgggcggggcgggactcggctctgatgccccgccgcgccccaggtttgggttctataaatacatgaagatggacaaggaggagggggatgaggatgaagaagacgaggtgcagcgccgagccttcctcttcctcaacccggacggtgagtgtccgcagcgcccctggcccgcacccacctgcgcagggagcttctaacccgcgtttcccgcagacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccg

SEQ ID NO: 15538 - DNA, 414 bp, Homo sapiens
cgtgtcagcgccaggctggacccagcgagccgccgatgccagcgagatgccaggctggactcagcaagccgccgatgccagccagacgcagagcagagaacgctggtcaaagagcagctaggcggtgtctgctcggccgaagcccagtcccggagaggcaggctctgtaccaggacgtggaggctccggggtcatgaaacccccagggtgagagacaaaggtagtgagtggccgtccagggcagaggggacggaggcagcacgcggacggagcctccgcacagagcgtcacggccacgactggaaagctcagacacgtgtcacgagcccacagcccaggtcagaggcggcaggatggcgggcggccccatgcacagaactgcggccacgtgtggaaggcgacggacactggcgg

SEQ ID NO: 15539 - DNA, 987 bp, Homo sapiens
cgaggagcccgcgccctcaggactggactgacccaccttgaggttgacgatgggcacggctgcgcggtcggcacggcgcacgatgctgtacaggtcctgcaggcgcgaggacaggaaggcgcggaaggtgcccgccagccccacggcccgcgcctgctggaagcactggaagtcggccccgcggatgccccgcatgccgcctgacagggggctgttgagcgcaaccaggtggagctgcggggagaggggcgcgtcacgggctgtgtcccacgctgccccctgcacccaggccccgggcgcaccaccccggccccgcacctgtgtggacaggcacggccgaggggcgctgagcgggaggcgcgcaagtgacacactgaggggcccaggcagcagcccccatacgctgccaggtcagagcagccccgggccacgtgggtgcccccagctgccgctgtaggcggaggtacgccggttcctcaaggatgtgacagcggctggactttcatgaccactgcttggccaccagagggcaagtcccagggccagccaagccgccctgagtggccctgagccgccagacccccacccatggccgaagcctgggacccccagcagctctgcaggggctgggccctcttctgctgccgagagccgaggggctagatggagccaagcccactttgggggggcactcaccaccggctggaagtcgcggtggctgtgggcgggtgggcttgtgggtcgcgccggccgcaggtgcacgtaggagctgtggtgcggggctccggggtagggctggggctcgggcaggcgaggggggctggccaggatgtcatctgcccgccagggccgcgcggtggggtgggggtgctcccgccgcgggtaggggttgctgtcgtgcagctgcaccacggggggctgcaaggcggccacttcattgtcctgcaggtgggagacgtggggcctgtcggcggggggaccctccgg

SEQ ID NO: 15540 - DNA, 1061 bp, Homo sapiens
cggggcagggggcggctgccgcaagggtgggacccgcgggttccgaggctttcctggtggtggagacgcgccgaggccgtttccactccaagccccttttccaggtggtgagccggctgggcctggactccctgtgccccttcagccctaaggagcggatcatcgagtgagcctctgccctcccgccctcttctcacccctcccgggctctgcctctcgggccttgcggggcgctggggtccctgcgtggagacccggctgagtcctcccagcgcctccctttgggcgcctactcggcctgcgccaagccggggtctgggggctgaggggggcacagagaccccggccgggtccccgcaggttctcagccgagtggtcacctccccgtgggtgcagacgggcgtggggcctggggccgccccgggaggactgcgctccccccaccaaccccggccagacccgctgagccgcgcccaccctgcaggtacctggtccctgagcgcgggcctgagcgaggcctgggcagcaagtccctgcgcgccttcgtgggggaggtgggtgcccgctctgcggcccccgggggcggctcggtggcggcggccgctgcggccatggtgagcgcggggggaggggcaggggaggcgcagttgttggggggagggcggggagggggaagggcgctgttggggggagggcacggggtggggagggcgcggtggggccgccctgggtggagacgtgggggccacacgggtgggacccccgcagggatcacccgggcccctggctcttcctggggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggtgagtggcggccacagcagggctccccgggccccaccaacagcga

SEQ ID NO: 15541 - DNA, 382 bp, Homo sapiens
cggacggtaaacacgcgtgggtttcccgtgtgcctgacggtaaagatgcatgggcctcctgtgtgccggatggtaaacaggccccgtgtgggtctcctgtgtgccggacagtaaacacacgtgggtcttccctgtgccggacagtaaacacacgtgggtctcccctgtgccggacagtaaacacgcgtgggtctccctgtgccggacagtaaacacgcgtgggtctcccctgtgccggacagtaaacacgcgtgggtctccctgtgccaaacggtaaacacgcgtgggtctctcgtgtgccgaacagtaaacacgcgtgggtctcccctgtgcccgacagtaaacacgcgtgggtctcccgtgtgccggatgataaacacgc

SEQ ID NO: 15542 - DNA, 261 bp, Homo sapiens
cgtcgattaggaggatcggtggcgacctcggccttcagtgtctccgacagagtgaaatggcggcggcggccgggatgatgctgctgggcttgctacaggcgggtgggtaggtgctgggccaggcgatggaggaggtggcaggcggcaacctcttgtccatgctgctgatcgcctgcgccttcaccctcagcctggtctacttgttccgtctcgctgccggccacctggtccagctgaccgcaggggcgaaaagtcctccgt

SEQ ID NO: 15543 - DNA, 892 bp, Homo sapiens
cgcggggctgtttaagcgttggcggaggccgggctgggtcgctgtgcgtctgctcctccttctcgcgcttctcctgccgccctaatcctgccttggccacgagggagcttgtgctcacgcagaccgggcagtgcgggaaccagatcggcgccaaggttggcagccggggctctgagggcccagcccgggcctgccgggtggccggggaagatgttggcagcggcgggggcggtgcccctgcattgcggcccctgggctccctgccggggacggtggaaccgggtggctggcgaggcggcgggggtggaccccagggacagggcggcctggggatgggggtgcggatgggggtgggagagcggctggggcgcctccgtgactcagccccggcctgtctggcccctcccgtctccgcagttctgggaggtgatctctgatgaacatgccatcgactccgctggcacctaccacggggacagccacctgcagctggagcgcatcaacgtgcaccaccacgaggccagcggtgcgacccccgtccttcccccaccgccctcctgggaacgcggccctcccctcgctcatgccctcccgccccacgcaggtggcaggtacgtgtcccgcgctgtgctcgtggatctggagccgggcaccatggactctgtgcgctcggggcccttcgggcaggtcttcaggccagacaacttcatttcccgtgagctgcgggcgaggactggggtgcggctccttagccagggcagctcgaaatccaggaacgctccaaggtcatcctgtgggaactgtggcgccagggcccctgaacaccctcctgtcctccgagtcgagtcgctccatctgcctcctaaacgggcttcgggaggaaggcccgcgt

SEQ ID NO: 15544 - DNA, 682 bp, Homo sapiens
cgcccagcaggcggcattgcgccctgacgccggggacccagcacccagccgtcctcgcccgcaggtgccctggctctgccccggccctccctggtctgtgtcctgactctgtttcccgtcgcccagaacgccgcagccagggcggcacacaagcctcgaggggcggggtccgggggcccctcttccatccgcctttcgtctccctccctgctggatctgaggcgccgctcccgccgcgctgtcctcgcgccatgccacgtcacgtcacgtcacgtcacgttacgttcccacgtcacgtccacgtcacgttcccacttcccgtccacagggaaacgggccccggcgatgtgagggcgtctgccgtgcttggtgccttcacaggggagcttcctgccttggccgcggttccaggctctgtgctgacgcagcaggagggtccccgggcagcccaggcaggcgacggggagtgacgagggtccttcacagccatgggagccgagcccagagcaggcggcagcagcgtctttgccacccctggcctaaaagcagccgtgtggggcccctgacaggtgccccggagcgaactgccctccttggcccagccctcagggtcctgccagggcccttgctgcccagaaggcccggggcccggctgacgacccgctacaccgtgggcccccgg

SEQ ID NO: 15545 - DNA, 223 bp, Homo sapiens
cgaaaaacagaggcgctgggtgcgaggcggagagatgcacaggtctggtcccggccccgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgt

SEQ ID NO: 15546 - DNA, 255 bp, Homo sapiens
cgggaggccgggttcggtgcatgggggccgggcacactttctctgggcatccctaggacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgc

SEQ ID NO: 15547 - DNA, 309 bp, Homo sapiens
cggcaggtttgctgcgctcgtcccagccagggcccagagtccctcggccagtttatcgcatctggaccccagatgggcgcgttgggtggtgcccgcgccagggaaagagctggcggctggctgagttgctgcgttcctgagcgctgtgcccgttgtgaccattggcgtggctgtctcccggcaggctcgaaggaatcgctgttctcctgcacgctgacggccagcgaggaggccatggcggtgctggaggaggtggtgctgtacgccttccagcagtgcgtctactatgtctccaaggtgcacggacgg

SEQ ID NO: 15548 - DNA, 992 bp, Homo sapiens
cgtgtgctcctccgggaaaccgacctcctctgggatgggcccggacatcgaggggcgggttcctgagagccgtcggggttctggtgtgggggtggccagggacatggagagcccgtggcgacagcatcccagccacgctgcttcagcaaccagtgactagacacgggacgcttttcccgtgtgctgctcgcgttacgcctgccctgagcggagtctctgtttcaggacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggtcagtgtgctggggtgggcggtctgggtcctgtgccggtctgggggaagagggggcccggagctggccccggctgggaggcgggagcgcctctatctgacccccacggtgctgtgctgctgagcgcagggcgg

SEQ ID NO: 15549 - DNA, 265 bp, Homo sapiens
cggggctgcccgtgaacacgccaagcacaacggggctgctgaccgtgaacacgccgaataaaacagggctgctgcccgtgaacacgccaaacaaaatggggctgctgcccgtgaacatgccgaataaaactgggagtccgaacctcttcatgtcaaataaagagtagggtccgaacctcttccccaggagggccagggttgcggccgggcgacgccaggtggggaagacactagaagaggagaaaaccaggagcgcaggacgcgg

SEQ ID NO: 15550 - DNA, 488 bp, Homo sapiens
cgcccgtgtctggcgggagaggacacggtctcctaggcgcgctgtagaagctgactggagaaggcccgcgactctgctgagggttaaagaggaatcggaaagggcccggggtagacgtgggcgccacagggtgagccgggccaggctgagaggactcacgggctatgggagcttgtgggcgacggtccggcaggggcctgcggcgggaacagggacaaaatatacttaataaattgcccatttagagcaagttgtgtgggtacaatggcgagaaaacggtcagtaatggagacgctgctccgtagtcgcccacttctctttctccaggcgcgcactggacggctgagcgattgtgaggccccagtggggctggtgacagaaccaaggcgcgccgaagcgcgcggcagcacccccgccctagggcgcctaccagaggggtaaaagggcaaaagagagagcccctcccccaccacgcccgcctccgccgg

SEQ ID NO: 15551 - DNA, 676 bp, Homo sapiens
cgccggatgaactctgtcccttcagaagaaagccgggttggtgtgctcgatgacgcagcgcttgcagtggcgtttgacaaagcgcagggcctccacggagacctcgcagtcctggacattcagcgtctggaggtcaaagcagttggcggccacgatctgcaagccctggccggtgatgctctcgcaggacttgaggctgagccgcttgaggttgaagcagttcagggccaggcactccaggcccgtgtcggataccaaagggcatttgccgatatccagggatttgagtttggtgcagttcttggcgaggtactccacaccgtggtccgtgatgccctcgcagcccctcgcgttgaggtagcgcagcttgctgcagtacttggccacgtagcggatgcccacgtcggtgacccggccgcagtgcgcgatgctcaggtaccgcaggcgggactccagcttggcgatctcccgcaggccgaagtcgctgacgaagcggcagtcgctgacgctcagctccttgatggaggcgcagtagatcaccaggtagcgcaggccttcgtcggtcaggcggacgcagcggcgcaggtagaggtgggtgagctgcgtgcagtgcgccgcgatggtgtgcaggccttcgtcctccagcacgaagcagtccgtcatgtccaggtagcgg

SEQ ID NO: 15552 - DNA, 1238 bp, Homo sapiens
cgacagattactcaggccgcacagagcgcgtgcacaaggccgtcgctccccttgtgacgcaagacttcattccctggatgtcagcggcctggaagcgcaacgtttcctgggcaacgccattgtcgcagctccgggtgggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgc

SEQ ID NO: 15553 - DNA, 220 bp, Homo sapiens
cgggacaggctgggcgccggcacccagtggccgcaggggctgtcgtgtgctttgcagatggacacgcgctatttaacatagagatgcgctgagtccgggtgattagtgaatcgcacgtcatcgcagacactagaaagcgaaagcatacgggggaaggccccgggcacagacccagcacggccaccactcgagctggagctgcctgcgagacgatgagcgt

SEQ ID NO: 15554 - DNA, 631 bp, Homo sapiens
cggtactccaagcacgcgagtctgcgcaggaggcgcttcgctctccggagctccccactgcctcctagacacagtcccggctccttaccccgggcggaggctcttccagacgggtcccgactgcctctgtatgcccactgctgccgtgccagaagccactgccctctcctcgcccctttccaaatgtgccctgcctcaggcccgtgtcatgctgttccctgtgccgctttcgcccgtcccctcactccccgccaccagaaccgggaaggcggtgccccctttccaggcccaacttccggcactgaacctctaggagtccgcagcctcctccgcccgggcctctccccgctggctcagaccgcagggccagcagccccgcccacacggaagccccgcccatcaggccgaccccgcccctcctgcctcggccccgccctcgccttggccccgcctcctcgctggcagccggcaggcgcagtcggggtcgtgggacccaggaggggcctccagcaggtgccttggcgaagatcctggactgcgtcacagcccagggtagccgtcccgcggcccggctttggagcttcccacggacacccggggctctgcctcctccgaaatcacccctcaccgc

SEQ ID NO: 15555 - DNA, 904 bp, Homo sapiens
cggcagaagattcgcttttccccgcctgaaaggtgccgcccagctggcagcgcaatggcaggagcccgggctacgcgagcgcggggtggatgttggaggggaaggccgggagctggctccgtggaaaaggctcctgcgtgtctcggaacatgttgctgggtcggtggatttcgctgctcatttttgtggatgaaacatgcatgttacattacataagggatcaggtggaagaatgaacaggttggcttaagcacacgtcctggctggtgctcggagagtgggcatttctttctgccacactgaggagctgcctcctcagacggacgtgacatgactttctcggcttctcactgtcacagcgcgagaggcgggggcctgagacccgacgctgcccaggtcacagcagcgggcggcgtgccggcaggtgcgcgcctgttagacccggcgtgagtgtagtttaacaacgaatctgcaggctgcctgccgtcatgcacgtggccatcgcttcagctttgctcctttccaggtttcgggatgctcggggtgaatggggaggcggccgccccaagggaggacccaggcagcgtcggcctcccgcttggggtcccttcccagaccctcgcctgaacgagtgggacagctcctgccccccagcgcgtccccaggctccgggatggtcactgtccaggaggcgcttggccctgctcacccgcccgttctgcccatcccttgagaactccgcgatttcgaaactttcctgatctttctgccggaagtaatttgttctacgtgaaaccacgggccactccttcatatctgtagagcgctctaccttctgtaacgtttatctgcgaaactgctgcgttaggccaggagcactccaagagcgagaggcagacgccgt

SEQ ID NO: 15556 - DNA, 519 bp, Homo sapiens
cggcggtcgcacctctcgcagacgcgcacggtccaggctgcgatgatccaggaggagatgctgaagaccagcagcacggtgccggggcagatggtcatgagtgtcttcatgacgaagcgcgtgttgaaggtgatcttgttgagggccccgatgctgcggctcgaggcgtccgtgaagattttgctgtgcagtagcatcacccggcccagcaggtagaggcgcaggaacatggggatggacagcagcacgtccacgtcggcctcggccaccgagggcgcgtacgtgaaggccagccgcgccgtccacgtgaagcggtagtggccgggcaccgggtgaatggcgcacactgccagctctagcgagatgaggaacacgcgctcgcaggtcatggcgatgcgccagtcatcagccccgttgtccaccatgaacagctgtggagggcgggagggaaccagccatgggtgtcagacacgcgccgcgctccctgcccagccccaccgcgcccccagagagtgacgt

SEQ ID NO: 15557 - DNA, 204 bp, Homo sapiens
cgcgcagggaggtgcagacgcaggcccgtggggaggcacgtggcagcaggacttacctctggggtgccccgggtcggtgaactcatacttccccacgccaatggtccgcagcatctgcagcccgtgggccgagtcggttgtggggggcccattggtggcaggggcaccactggggagagtggcggacggctgggctggcggcgg

SEQ ID NO: 15558 - DNA, 444 bp, Homo sapiens
cgtggccgactgtcatcccacttcgaaacacgcagaggggaaggcagcccgagggctctttctcccaggaagtttctgggcagctgccgccgggcgccaggacaagcgagggtggcctgagtcctgtgctcacatggcgtatgccgcccagtagatgacattgacggccgcaaacgccgcagggaacacagcgcgggcgtaaatgtcaatggtgtctgcgtcgatgggcctgagccgggcacggatgcccccctggcctcctgagcgggctgccccctccttcttcgtctcccctgtctccacccccaccgacctgtaggagcccatcaggttccccgggacgcggcgctgccggcgggagatggccagctcctgcgtgacgccggcagcagagagggagaagaggacaatggcgttcctcacgtccatctgcacgaaggccgg

SEQ ID NO: 15559 - DNA, 397 bp, Homo sapiens
cggaagctgagtgcgtcccgagcaggcctaccatctagggtgggggtgggcggacgtgtccccaccgcctgtcgtcggcccccagctggccctggcgaggcaggagctcttggggccatctgctcgggcctatttttgcctcggtcccgcagtgcctgcggagcccggtgggaggagccggtctgagtcactgccaccacccggctccccctgttgagagtggactccgtgcgtgtgtcccccaggaacggtgacaagtacgacggcgactgggtccgggaccggcgtcagggacacggggtgctgcgctgcgccgacggctccacctacaaggtacccgggggcgcgcggcacctgctgcccagagggtacaggcctcgtggtgggcagggcgcgt

SEQ ID NO: 15560 - DNA, 1530 bp, Homo sapiens
cggctgtccccgcctccaaaaccgccctggcgcgcgttcggccgcccccatacccgccgtggcgcgcgttcagccgctccatgtactgagcggtcacgtccacggcctccgcctccggcagctgcaggttccccgaaacgttgcatcgcaggtcgttccagtccgagcgcagcagctcgaagtccacggcgcccacgctgaacgtgcgctgccagtcgatggcgtcctcacgccagcgtccgagcgccgggcccgcggcctcctcgctgtcctccgacgcggcctcgtcgcccggggccccatcgtcctccccttcctcctcctcttcgccctccccgggcagctgcggcccggacacctgggacaagctcaggaaggaggtcacgggccgcgcttcggaggacaagtttgagtccactgtgggcgccgcaggtcccagcgtgcgcgcctggccctcccggcccccttgggtggcctgcgcccgggctgggggcctcggctgtgtggcctgggggccgccggtcctgcggccgtggggccggggtgggcgtgggggcgcccgcagctgcactctgggcagaggcctggggtgcaggaagacgccagggaagggcggccagggcgcacgcggcgctggggcccggggggatgcccgctgtcccggccgcaccctggtcacgtacacctttgggggcggctgctccactgcagggcgcgggggcggagctcggcccaagaagagcggcaaagggcgggcggccctggcggcccagctcagggcccgggagtgcctgggggtccccccgtcccgggggcggggaggggtcggcggggcgagggtggctccgggctgggcgggggctgctggggcgggggactgggggccgctcctgggcggggccgcctcggtgggctccaggctgtcgagcagctccccctcgtcctcgtcgtccaggaagtctgcgggaaacgcgggttagaagctccctgcgcaggtgggtgcgggccaggggcgctgcggacactcaccgtccgggttgaggaagaggaaggctcggcgctgcacctcgtcttcttcatcctcatccccctcctccttgtccatcttcatgtatttatagaacccaaacctggggcgcggcggggcatcagagccgagtcccgccccgcccaccccgccccgcattagcccggccgcgcgcccacctctccagatacagcggagactcgcggtagaagcacttgttgtccgtctccatgtgggtgaggcgagtgtagtcgttgggataaacgaaggacaggtacacctggggggtgggggggcgcagggctcagggcgcggacctcccggggcggcctcccaaggggctggagaaggctccgcggagtcccggacgggagacggggtctccagccgcactcacaaattgcaggccctggtatctggcgatcgggaagtccttgaccacgtaggtgggggcgtaggcgcagggctccagcacgttctccaggctcgaagattccatgcgt

SEQ ID NO: 15561 - DNA, 414 bp, Artificial Sequence
  Description of Artificial Sequence: Synthetic polynucleotide
tygttagtgttygtygttttttataygtggtygtagttttgtgtatggggtygttygttattttgtygtttttgatttgggttgtgggttygtgataygtgtttgagttttttagtygtggtygtgaygttttgtgyggaggtttygttygygtgttgttttygttttttttgttttggayggttatttattatttttgttttttattttgggggttttatgatttyggagtttttaygttttggtatagagtttgttttttygggattgggtttyggtygagtagatatygtttagttgttttttgattagygttttttgttttgygtttggttggtatyggyggtttgttgagtttagtttggtatttygttggtatyggyggttygttgggtttagtttggygttgatayg

SEQ ID NO: 15562 - DNA, 987 bp, Artificial Sequence
  Description of Artificial Sequence: Synthetic polynucleotide
tyggagggttttttygtygataggttttaygttttttatttgtaggataatgaagtggtygttttgtagtttttygtggtgtagttgtaygatagtaatttttattygyggygggagtatttttattttatygygyggttttggygggtagatgatattttggttagtttttttygtttgttygagttttagttttatttyggagtttygtattatagtttttaygtgtatttgyggtyggygygatttataagtttattygtttatagttatygygatttttagtyggtggtgagtgtttttttaaagtgggtttggttttatttagtttttyggttttyggtagtagaagagggtttagtttttgtagagttgttgggggttttaggtttyggttatgggtgggggtttggyggtttagggttatttagggyggtttggttggttttgggatttgttttttggtggttaagtagtggttatgaaagtttagtygttgttatatttttgaggaatyggygtattttygtttatagyggtagttgggggtatttaygtggttyggggttgttttgatttggtagygtatgggggttgttgtttgggttttttagtgtgttatttgygygtttttygtttagygtttttyggtygtgtttgtttatataggtgyggggtyggggtggtgygttyggggtttgggtgtagggggtagygtgggatatagttygtgaygygttttttttttygtagttttatttggttgygtttaatagttttttgttaggyggtatgyggggtattygyggggtygatttttagtgtttttagtaggygygggtygtggggttggygggtatttttygygtttttttgttttygygtttgtaggatttgtatagtatygtgygtygtgtygatygygtagtygtgtttatygttaattttaaggtgggttagtttagttttgagggygygggtttttyg

SEQ ID NO: 15563 - DNA, 1061 bp, Artificial Sequence
  Description of Artificial Sequence: Synthetic polynucleotide
tygttgttggtggggttyggggagttttgttgtggtygttatttattaggtaggyggtgaaggtttyggygtyggtatttattagygtggttagtttggtygaagtttygyggaagggygggattaggygtygtatygtygtgtttagggattggaattggygtygttygtaggttatgaggtttattatggagtttagygtygtattttgygagaggggtggatgtgggggtygtagggattttagayggttygggatygattttaggaagagttaggggttygggtgatttttgygggggttttattygtgtggtttttaygtttttatttagggyggttttatygygttttttttatttygtgttttttttttaatagygttttttttttttttygttttttttttaataattgygttttttttgttttttttttygygtttattatggtygtagyggtygtygttatygagtygttttygggggtygtagagygggtatttattttttttaygaaggygygtagggatttgttgtttaggtttygtttaggttygygtttagggattaggtatttgtagggtgggygyggtttagygggtttggtyggggttggtggggggagygtagttttttyggggyggttttaggttttaygttygtttgtatttayggggaggtgattattyggttgagaatttgyggggattyggtyggggtttttgtgttttttttagtttttagatttyggtttggygtaggtygagtaggygtttaaagggaggygttgggaggatttagtygggtttttaygtagggattttagygtttygtaaggttygagaggtagagttygggaggggtgagaagagggygggagggtagaggtttattygatgattygttttttagggttgaaggggtatagggagtttaggtttagtyggtttattatttggaaaaggggtttggagtggaaayggtttyggygygtttttattattaggaaagtttyggaattygygggttttatttttgyggtagtygttttttgtttyg

SEQ ID NO: 15564 - DNA, 382 bp, Artificial Sequence
  Description of Artificial Sequence: Synthetic polynucleotide
gygtgtttattattyggtataygggagatttaygygtgtttattgtygggtataggggagatttaygygtgtttattgttyggtataygagagatttaygygtgtttatygtttggtatagggagatttaygygtgtttattgttyggtataggggagatttaygygtgtttattgttyggtatagggagatttaygygtgtttattgttyggtataggggagatttaygtgtgtttattgttyggtatagggaagatttaygtgtgtttattgttyggtatataggagatttatayggggtttgtttattattyggtatataggaggtttatgtatttttatygttaggtataygggaaatttaygygtgtttatygttyg

SEQ ID NO: 15565 - DNA, 261 bp, Artificial Sequence
  Description of Artificial Sequence: Synthetic polynucleotide
ayggaggatttttygtttttgyggttagttggattaggtggtyggtagygagayggaataagtagattaggttgagggtgaaggygtaggygattagtagtatggataagaggttgtygtttgttattttttttatygtttggtttagtatttatttattygtttgtagtaagtttagtagtattatttyggtygtygtygttattttattttgtyggagatattgaaggtygaggtygttatygatttttttaatygayg

SEQ ID NO: 15566 - DNA, 892 bp, Artificial Sequence
  Description of Artificial Sequence: Synthetic polynucleotide
aygygggtttttttttygaagttygtttaggaggtagatggagygattygattyggaggataggagggtgtttaggggttttggygttatagtttttataggatgattttggagygtttttggatttygagttgttttggttaaggagtygtattttagttttygttygtagtttaygggaaatgaagttgtttggtttgaagatttgttygaagggtttygagygtatagagtttatggtgttyggttttagatttaygagtatagygygggataygtatttgttatttgygtggggygggagggtatgagygaggggagggtygygtttttaggagggyggtgggggaaggaygggggtygtatygttggtttygtggtggtgtaygttgatgygttttagttgtaggtggttgttttygtggtaggtgttagyggagtygatggtatgtttattagagattattttttagaattgyggagaygggaggggttagataggtyggggttgagttayggaggygttttagtygtttttttatttttattygtatttttatttttaggtygttttgtttttggggtttattttygtygtttygttagttattyggttttatygttttyggtagggagtttaggggtygtaatgtaggggtatygttttygtygttgttaatatttttttyggttattyggtaggttygggttgggtttttagagtttyggttgttaattttggygtygatttggttttygtattgttyggtttgygtgagtataagttttttygtggttaaggtaggattagggyggtaggagaagygygagaaggaggagtagaygtatagygatttagttyggttttygttaaygtttaaatagtttygyg

SEQ ID NO: 15567 - DNA, 682 bp, Artificial Sequence
  Description of Artificial Sequence: Synthetic polynucleotide
tygggggtttayggtgtagygggtygttagtygggtttygggttttttgggtagtaagggttttggtaggattttgagggttgggttaaggagggtagttygtttyggggtatttgttaggggttttatayggttgtttttaggttaggggtggtaaagaygttgttgtygtttgttttgggttyggtttttatggttgtgaaggattttygttatttttygtygtttgtttgggttgttyggggatttttttgttgygttagtatagagtttggaatygyggttaaggtaggaagtttttttgtgaaggtattaagtayggtagaygtttttatatygtyggggttygtttttttgtggaygggaagtgggaaygtgaygtggaygtgaygtgggaaygtaaygtgaygtgaygtgaygtgaygtggtatggygygaggatagygyggygggagyggygttttagatttagtagggagggagaygaaaggyggatggaagaggggttttyggatttygtttttygaggtttgtgtgtygttttggttgyggygttttgggygaygggaaatagagttaggatatagattagggagggtyggggtagagttagggtatttgygggygaggayggttgggtgttgggttttyggygttagggygtaatgtygtttgttgggyg

SEQ ID NO: 15568 - DNA, 223 bp, Artificial Sequence
  Description of Artificial Sequence: Synthetic polynucleotide
aygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyggggtygggattagatttgtgtattttttygtttygtatttagygtttttgtttttyg

SEQ ID NO: 15569 - DNA, 255 bp, Artificial Sequence
  Description of Artificial Sequence: Synthetic polynucleotide
gyggatagttygaatgtattgtagaagtattygtttattagtgggttttatygtygggtataggtttgtgtgtttagggtagagygtttggtgtatgttgtggagggygtgggtaatggygtatatygtattaattataaattgtattttgtttttttgttygtaggtggagtttyggtygatgygtttttygtttgttttagggatgtttagagaaagtgtgttyggtttttatgtatygaattyggtttttyg

SEQ ID NO: 15570 - DNA, 309 bp, Artificial Sequence
  Description of Artificial Sequence: Synthetic polynucleotide
tygttygtgtattttggagatatagtagaygtattgttggaaggygtatagtattattttttttagtatygttatggttttttygttggtygttagygtgtaggagaatagygattttttygagtttgtygggagatagttaygttaatggttataaygggtatagygtttaggaaygtagtaatttagttagtygttagttttttttttggygygggtattatttaaygygtttatttggggtttagatgygataaattggtygagggattttgggttttggttgggaygagygtagtaaatttgtyg

SEQ ID NO: 15571 - DNA, 992 bp, Artificial Sequence
  Description of Artificial Sequence: Synthetic polynucleotide
tygttttgygtttagtagtatagtatygtgggggttagatagaggygttttygttttttagtyggggttagtttygggttttttttttttttagatyggtataggatttagatygtttattttagtatattgatttagatagtttygyggattagtttggttattttgagtaggagttgttygaatgtgttyggttggaagtgggtggtygagtgttggatgtagaggtataggaggaaggygggggttagtttgtggtygtygtttttyggttygattaaygttatgattttttgtagtagygtgttttttaggtggggtttaaattttaggagtagttgttggygtyggggtagggyggtttgagtaggggaggyggtttttygggtttygagygyggtttygtatagtyggtagttttgyggtatagttyggaggygygttaaggttygggygggtaggggttgggtttgygyggggtttttgaatagtagtaggtagtagagttttagggagagtaggttttygtggtgtagtattayggttttgtgttttatttyggagaagttgayggagatgtgygtttyggggatgggttttaggattagttttttygyggtttggtygttgttygggagyggttgtyggyggatggtgtagtgtagaggtaggatgtygggggttgagaggttgatgttgggtttgttggagggggttygttggtttatygtgtgtyggtttyggttgagtatatatattaggttgttttgaaatagagatttygtttagggtaggygtaaygygagtagtataygggaaaagygtttygtgtttagttattggttgttgaagtagygtggttgggatgttgtygttaygggttttttatgtttttggttatttttatattagaatttygayggtttttaggaattygtttttygatgttygggtttattttagaggaggtyggtttttyggaggagtatayg

SEQ ID NO: 15572 - DNA, 265 bp, Artificial Sequence
  Description of Artificial Sequence: Synthetic polynucleotide
tygygttttgygtttttggttttttttttttttagtgttttttttatttggygtygttyggtygtaattttggtttttttggggaagaggttyggattttattttttatttgatatgaagaggttyggatttttagttttattyggtatgtttaygggtagtagttttattttgtttggygtgtttaygggtagtagttttgttttattyggygtgtttayggttagtagtttygttgtgtttggygtgtttaygggtagtttyg

SEQ ID NO: 15573 - DNA, 488 bp, Artificial Sequence
  Description of Artificial Sequence: Synthetic polynucleotide
tyggyggaggygggygtggtgggggaggggtttttttttttgtttttttatttttttggtaggygttttagggygggggtgttgtygygygtttyggygygttttggttttgttattagttttattggggttttataatygtttagtygtttagtgygygtttggagaaagagaagtgggygattayggagtagygtttttattattgatygttttttygttattgtatttatataatttgttttaaatgggtaatttattaagtatattttgtttttgttttygtygtaggtttttgtyggatygtygtttataagtttttatagttygtgagtttttttagtttggttyggtttattttgtggygtttaygtttatttygggtttttttygatttttttttaatttttagtagagtygygggttttttttagttagtttttatagygygtttaggagatygtgttttttttygttagataygggyg

SEQ ID NO: 15574 - DNA, 676 bp, Artificial Sequence
  Description of Artificial Sequence: Synthetic polynucleotide
tygttatttggatatgayggattgtttygtgttggaggaygaaggtttgtatattatygyggygtattgtaygtagtttatttatttttatttgygtygttgygttygtttgatygaygaaggtttgygttatttggtgatttattgygtttttattaaggagttgagygttagygattgtygtttygttagygatttyggtttgygggagatygttaagttggagtttygtttgyggtatttgagtatygygtattgyggtygggttatygaygtgggtattygttaygtggttaagtattgtagtaagttgygttattttaaygygaggggttgygagggtattayggattayggtgtggagtatttygttaagaattgtattaaatttaaatttttggatatyggtaaatgttttttggtattygataygggtttggagtgtttggttttgaattgttttaattttaagyggtttagttttaagttttgygagagtattatyggttagggtttgtagatygtggtygttaattgttttgatttttagaygttgaatgtttaggattgygaggttttygtggaggttttgygttttgttaaaygttattgtaagygttgygttatygagtatattaattyggtttttttttgaagggatagagtttattyggyg

SEQ ID NO: 15575 - DNA, 1238 bp, Artificial Sequence
  Description of Artificial Sequence: Synthetic polynucleotide
gyggtttaaaggtatyggaygttggggttaagatgattttygygttgttatgaattaggttattggaygygggtttygygtygagtttgtagttttygaggagtttttygggttttttygttttgattatattttttyggatggttgtygggtttttgtttgtttygttttgtatygagttttttatgatttttttygtttttagtttgtttttttygttttttyggaagtagtygagggtyggttyggggttttttaatttgattattttggaggttttaggatyggtttygayggtttttygaggttttattgattgatttaggttgggttttagtttttgttttttggttttgatatgtagygttaggggttgtatygggtgtaattygggtttggaggtggygtygtttgaygttgtyggyggttgtaggagtygtaggtygggtttgaattgtaatagtygygtttgygyggaygaggtagyggttttttygttttgggtttgaggttgtggtagtagtaatatttgttttggttttatttgtagtagtygtygtatygygggttgtaagtyggaygttattgttttttygtaygaygaggttaaggtygtattggttgtygygtttagtgtgggagaygayggagggggttttatggttgttgtttaaaaggaggtgttttygatyggtagygggggyggagygggaygtaaygggygyggttgaggyggyggttygggtttggttttttttatgggggagggggaygtttyggttaggattgtgagtttagtygtttgttggygattttttttttttttttttyggttaagagttttgtaaggtttttgttatttagaattttaygyggtttaaaaygtagttgtttgtttgggttttatttaattataaygatygatattygtggayggttaattataggygggtttttyggttttttttggtttttattttygtttygtgttgagttttygaattatttgttatggtaggagtygtygtatttgttgtatattttygttttgatttttttgtggagtttttttatagtygttgtttttagttattttttttttattyggagttgygataatggygttgtttaggaaaygttgygtttttaggtygttgatatttagggaatgaagttttgygttataaggggagygayggttttgtgtaygygttttgtgyggtttgagtaatttgtyg

SEQ ID NO: 15576 - DNA, 220 bp, Artificial Sequence
  Description of Artificial Sequence: Synthetic polynucleotide
aygtttatygtttygtaggtagttttagttygagtggtggtygtgttgggtttgtgttyggggttttttttygtatgttttygttttttagtgtttgygatgaygtgygatttattaattattyggatttagygtatttttatgttaaatagygygtgtttatttgtaaagtataygatagtttttgyggttattgggtgtyggygtttagtttgtttyg

SEQ ID NO: 15577 - DNA, 631 bp, Artificial Sequence
  Description of Artificial Sequence: Synthetic polynucleotide
gyggtgaggggtgatttyggaggaggtagagtttygggtgttygtgggaagttttaaagtygggtygygggayggttattttgggttgtgaygtagtttaggattttygttaaggtatttgttggaggttttttttgggttttaygatttygattgygtttgtyggttgttagygaggaggyggggttaaggygagggyggggtygaggtaggaggggyggggtyggtttgatgggyggggttttygtgtgggyggggttgttggttttgyggtttgagttagyggggagaggttygggyggaggaggttgyggatttttagaggtttagtgtyggaagttgggtttggaaagggggtatygttttttyggttttggtggyggggagtgaggggaygggygaaagyggtatagggaatagtatgataygggtttgaggtagggtatatttggaaaggggygaggagagggtagtggtttttggtayggtagtagtgggtatatagaggtagtygggattygtttggaagagttttygttyggggtaaggagtygggattgtgtttaggaggtagtggggagtttyggagagygaagygttttttgygtagattygygtgtttggagtatyg

SEQ ID NO: 15578 - DNA, 904 bp, Artificial Sequence
  Description of Artificial Sequence: Synthetic polynucleotide
ayggygtttgtttttygtttttggagtgtttttggtttaaygtagtagtttygtagataaaygttatagaaggtagagygttttatagatatgaaggagtggttygtggttttaygtagaataaattattttyggtagaaagattaggaaagtttygaaatygyggagtttttaagggatgggtagaaygggygggtgagtagggttaagygttttttggatagtgattatttyggagtttggggaygygttggggggtaggagttgttttattygtttaggygagggtttgggaagggattttaagygggaggtygaygttgtttgggtttttttttggggyggtygtttttttatttatttygagtatttygaaatttggaaaggagtaaagttgaagygatggttaygtgtatgayggtaggtagtttgtagattygttgttaaattatatttaygtygggtttaataggygygtatttgtyggtaygtygttygttgttgtgatttgggtagygtygggttttaggttttygtttttygygttgtgatagtgagaagtygagaaagttatgttaygttygtttgaggaggtagttttttagtgtggtagaaagaaatgtttatttttygagtattagttaggaygtgtgtttaagttaatttgtttatttttttatttgattttttatgtaatgtaatatgtatgttttatttataaaaatgagtagygaaatttatygatttagtaatatgtttygagataygtaggagttttttttayggagttagttttyggtttttttttttaatatttatttygygttygygtagttygggtttttgttattgygttgttagttgggyggtattttttaggyggggaaaagygaattttttgtyg

SEQ ID NO: 15579 - DNA, 519 bp, Artificial Sequence
  Description of Artificial Sequence: Synthetic polynucleotide
aygttattttttgggggygyggtggggttgggtagggagygyggygygtgtttgatatttatggttggttttttttygttttttatagttgtttatggtggataayggggttgatgattggygtatygttatgatttgygagygygtgttttttatttygttagagttggtagtgtgygttatttattyggtgttyggttattatygttttaygtggayggygyggttggtttttaygtaygygttttyggtggtygaggtygaygtggaygtgttgttgtttatttttatgtttttgygtttttatttgttgggtygggtgatgttattgtatagtaaaatttttayggaygtttygagtygtagtatyggggtttttaataagattatttttaataygygtttygttatgaagatatttatgattatttgtttyggtatygtgttgttggtttttagtatttttttttggattatygtagtttggatygtgygygtttgygagaggtgygatygtyg

SEQ ID NO: 15580 - DNA, 204 bp, Artificial Sequence
  Description of Artificial Sequence: Synthetic polynucleotide
tygtygttagtttagtygttygttattttttttagtggtgtttttgttattaatgggttttttataatygattyggtttaygggttgtagatgttgyggattattggygtggggaagtatgagtttatygattyggggtattttagaggtaagttttgttgttaygtgtttttttaygggtttgygtttgtatttttttgygyg

SEQ ID NO: 15581 - DNA, 444 bp, Artificial Sequence
  Description of Artificial Sequence: Synthetic polynucleotide
tyggttttygtgtagatggaygtgaggaaygttattgtttttttttttttttttgttgtyggygttaygtaggagttggttatttttygtyggtagygtygygtttyggggaatttgatgggtttttataggtyggtgggggtggagataggggagaygaagaaggagggggtagttygtttaggaggttaggggggtattygtgttyggtttaggtttatygaygtagatattattgatatttaygttygygttgtgttttttgyggygtttgyggtygttaatgttatttattgggyggtataygttatgtgagtataggatttaggttattttygtttgttttggygttyggyggtagttgtttagaaattttttgggagaaagagttttygggttgtttttttttttgygtgtttygaagtgggatgatagtyggttayg

SEQ ID NO: 15582 - DNA, 397 bp, Artificial Sequence
  Description of Artificial Sequence: Synthetic polynucleotide
aygygttttgtttattaygaggtttgtattttttgggtagtaggtgtygygygttttygggtattttgtaggtggagtygtyggygtagygtagtatttygtgtttttgaygtyggtttyggatttagtygtygtygtatttgttatygtttttgggggatataygtayggagtttatttttaatagggggagtygggtggtggtagtgatttagatyggttttttttatygggtttygtaggtattgygggatygaggtaaaaataggttygagtagatggttttaagagtttttgtttygttagggttagttgggggtygaygataggyggtggggataygttygtttatttttattttagatggtaggtttgttygggaygtatttagttttyg

SEQ ID NO: 15583 - DNA, 1530 bp, Artificial Sequence
  Description of Artificial Sequence: Synthetic polynucleotide
aygtatggaattttygagtttggagaaygtgttggagttttgygtttaygtttttatttaygtggttaaggatttttygatygttagatattagggtttgtaatttgtgagtgyggttggagatttygtttttygttygggatttygyggagttttttttagttttttgggaggtygtttygggaggttygygttttgagttttgygtttttttattttttaggtgtatttgtttttygtttattttaaygattatattygttttatttatatggagayggataataagtgtttttatygygagttttygttgtatttggagaggtgggygygyggtygggttaatgyggggyggggtgggyggggygggattyggttttgatgtttygtygygttttaggtttgggttttataaatatatgaagatggataaggaggagggggatgaggatgaagaagaygaggtgtagygtygagttttttttttttttaattyggayggtgagtgttygtagygtttttggttygtatttatttgygtagggagtttttaattygygtttttygtagattttttggaygaygaggaygagggggagttgttygatagtttggagtttatygaggyggtttygtttaggagyggtttttagtttttygttttagtagttttygtttagttyggagttattttygtttygtygattttttttygttttygggayggggggatttttaggtattttygggttttgagttgggtygttagggtygttygttttttgtygttttttttgggtygagtttygttttygygttttgtagtggagtagtygtttttaaaggtgtaygtgattagggtgyggtygggatagygggtattttttygggttttagygtygygtgygttttggtygtttttttttggygtttttttgtattttaggtttttgtttagagtgtagttgygggygtttttaygtttatttyggttttayggtygtaggatyggyggtttttaggttatatagtygaggtttttagttygggygtaggttatttaagggggtygggagggttaggygygtaygttgggatttgyggygtttatagtggatttaaatttgtttttygaagygyggttygtgattttttttttgagtttgttttaggtgttygggtygtagttgtttggggagggygaagaggaggaggaaggggaggaygatggggtttygggygaygaggtygygtyggaggatagygaggaggtygygggttyggygttyggaygttggygtgaggaygttatygattggtagygtaygtttagygtgggygtygtggatttygagttgttgygttyggattggaaygatttgygatgtaaygtttyggggaatttgtagttgtyggaggyggaggtygtggaygtgatygtttagtatatggagyggttgaaygygygttayggygggtatgggggyggtygaaygygygttagggyggttttggaggyggggatagtyg

SEQ ID NO: 15584 - DNA, 414 bp, Artificial Sequence
  Description of Artificial Sequence: Synthetic polynucleotide
ttgttagtgtttgttgttttttatatgtggttgtagttttgtgtatggggttgtttgttattttgttgtttttgatttgggttgtgggtttgtgatatgtgtttgagttttttagttgtggttgtgatgttttgtgtggaggttttgtttgtgtgttgtttttgttttttttgttttggatggttatttattatttttgttttttattttgggggttttatgattttggagtttttatgttttggtatagagtttgtttttttgggattgggttttggttgagtagatattgtttagttgttttttgattagtgttttttgttttgtgtttggttggtattggtggtttgttgagtttagtttggtattttgttggtattggtggtttgttgggtttagtttggtgttgatatg

SEQ ID NO: 15585 - DNA, 987 bp, Artificial Sequence
  Description of Artificial Sequence: Synthetic polynucleotide
ttggagggtttttttgttgataggttttatgttttttatttgtaggataatgaagtggttgttttgtagttttttgtggtgtagttgtatgatagtaatttttatttgtggtgggagtatttttattttattgtgtggttttggtgggtagatgatattttggttagttttttttgtttgtttgagttttagttttattttggagttttgtattatagtttttatgtgtatttgtggttggtgtgatttataagtttatttgtttatagttattgtgatttttagttggtggtgagtgtttttttaaagtgggtttggttttatttagttttttggtttttggtagtagaagagggtttagtttttgtagagttgttgggggttttaggttttggttatgggtgggggtttggtggtttagggttatttagggtggtttggttggttttgggatttgttttttggtggttaagtagtggttatgaaagtttagttgttgttatatttttgaggaattggtgtatttttgtttatagtggtagttgggggtatttatgtggtttggggttgttttgatttggtagtgtatgggggttgttgtttgggttttttagtgtgttatttgtgtgttttttgtttagtgttttttggttgtgtttgtttatataggtgtggggttggggtggtgtgtttggggtttgggtgtagggggtagtgtgggatatagtttgtgatgtgtttttttttttgtagttttatttggttgtgtttaatagttttttgttaggtggtatgtggggtatttgtggggttgatttttagtgtttttagtaggtgtgggttgtggggttggtgggtattttttgtgtttttttgtttttgtgtttgtaggatttgtatagtattgtgtgttgtgttgattgtgtagttgtgtttattgttaattttaaggtgggttagtttagttttgagggtgtgggttttttg

SEQ ID NO: 15586 - DNA, 1061 bp, Artificial Sequence
  Description of Artificial Sequence: Synthetic polynucleotide
ttgttgttggtggggtttggggagttttgttgtggttgttatttattaggtaggtggtgaaggttttggtgttggtatttattagtgtggttagtttggttgaagttttgtggaagggtgggattaggtgttgtattgttgtgtttagggattggaattggtgttgtttgtaggttatgaggtttattatggagtttagtgttgtattttgtgagaggggtggatgtgggggttgtagggattttagatggtttgggattgattttaggaagagttaggggtttgggtgatttttgtgggggttttatttgtgtggtttttatgtttttatttagggtggttttattgtgttttttttattttgtgttttttttttaatagtgtttttttttttttttgttttttttttaataattgtgttttttttgtttttttttttgtgtttattatggttgtagtggttgttgttattgagttgtttttgggggttgtagagtgggtatttattttttttatgaaggtgtgtagggatttgttgtttaggttttgtttaggtttgtgtttagggattaggtatttgtagggtgggtgtggtttagtgggtttggttggggttggtggggggagtgtagtttttttggggtggttttaggttttatgtttgtttgtatttatggggaggtgattatttggttgagaatttgtggggatttggttggggtttttgtgttttttttagtttttagattttggtttggtgtaggttgagtaggtgtttaaagggaggtgttgggaggatttagttgggtttttatgtagggattttagtgttttgtaaggtttgagaggtagagtttgggaggggtgagaagagggtgggagggtagaggtttatttgatgatttgttttttagggttgaaggggtatagggagtttaggtttagttggtttattatttggaaaaggggtttggagtggaaatggttttggtgtgtttttattattaggaaagttttggaatttgtgggttttatttttgtggtagttgttttttgttttg

SEQ ID NO: 15587 - DNA, 382 bp, Artificial Sequence
  Description of Artificial Sequence: Synthetic polynucleotide
gtgtgtttattatttggtatatgggagatttatgtgtgtttattgttgggtataggggagatttatgtgtgtttattgtttggtatatgagagatttatgtgtgtttattgtttggtatagggagatttatgtgtgtttattgtttggtataggggagatttatgtgtgtttattgtttggtatagggagatttatgtgtgtttattgtttggtataggggagatttatgtgtgtttattgtttggtatagggaagatttatgtgtgtttattgtttggtatataggagatttatatggggtttgtttattatttggtatataggaggtttatgtatttttattgttaggtatatgggaaatttatgtgtgtttattgtttg

SEQ ID NO: 15588 - DNA, 261 bp, Artificial Sequence
  Description of Artificial Sequence: Synthetic polynucleotide
atggaggattttttgtttttgtggttagttggattaggtggttggtagtgagatggaataagtagattaggttgagggtgaaggtgtaggtgattagtagtatggataagaggttgttgtttgttattttttttattgtttggtttagtatttatttatttgtttgtagtaagtttagtagtattattttggttgttgttgttattttattttgttggagatattgaaggttgaggttgttattgatttttttaattgatg

SEQ ID NO: 15589 - DNA, 892 bp, Artificial Sequence
  Description of Artificial Sequence: Synthetic polynucleotide
atgtgggttttttttttgaagtttgtttaggaggtagatggagtgatttgatttggaggataggagggtgtttaggggttttggtgttatagtttttataggatgattttggagtgtttttggattttgagttgttttggttaaggagttgtattttagtttttgtttgtagtttatgggaaatgaagttgtttggtttgaagatttgtttgaagggttttgagtgtatagagtttatggtgtttggttttagatttatgagtatagtgtgggatatgtatttgttatttgtgtggggtgggagggtatgagtgaggggagggttgtgtttttaggagggtggtgggggaaggatgggggttgtattgttggttttgtggtggtgtatgttgatgtgttttagttgtaggtggttgtttttgtggtaggtgttagtggagttgatggtatgtttattagagattattttttagaattgtggagatgggaggggttagataggttggggttgagttatggaggtgttttagttgtttttttatttttatttgtatttttatttttaggttgttttgtttttggggtttatttttgttgttttgttagttatttggttttattgtttttggtagggagtttaggggttgtaatgtaggggtattgtttttgttgttgttaatattttttttggttatttggtaggtttgggttgggtttttagagttttggttgttaattttggtgttgatttggtttttgtattgtttggtttgtgtgagtataagtttttttgtggttaaggtaggattagggtggtaggagaagtgtgagaaggaggagtagatgtatagtgatttagtttggtttttgttaatgtttaaatagttttgtg

SEQ ID NO: 15590 - DNA, 682 bp, Artificial Sequence
  Description of Artificial Sequence: Synthetic polynucleotide
ttgggggtttatggtgtagtgggttgttagttgggttttgggttttttgggtagtaagggttttggtaggattttgagggttgggttaaggagggtagtttgttttggggtatttgttaggggttttatatggttgtttttaggttaggggtggtaaagatgttgttgttgtttgttttgggtttggtttttatggttgtgaaggatttttgttattttttgttgtttgtttgggttgtttggggatttttttgttgtgttagtatagagtttggaattgtggttaaggtaggaagtttttttgtgaaggtattaagtatggtagatgtttttatattgttggggtttgtttttttgtggatgggaagtgggaatgtgatgtggatgtgatgtgggaatgtaatgtgatgtgatgtgatgtgatgtggtatggtgtgaggatagtgtggtgggagtggtgttttagatttagtagggagggagatgaaaggtggatggaagaggggtttttggattttgttttttgaggtttgtgtgttgttttggttgtggtgttttgggtgatgggaaatagagttaggatatagattagggagggttggggtagagttagggtatttgtgggtgaggatggttgggtgttgggtttttggtgttagggtgtaatgttgtttgttgggtg

SEQ ID NO: 15591 - DNA, 223 bp, Artificial Sequence
  Description of Artificial Sequence: Synthetic polynucleotide
atgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtggggttgggattagatttgtgtatttttttgttttgtatttagtgtttttgttttttg

SEQ ID NO: 15592 - DNA, 255 bp, Artificial Sequence
  Description of Artificial Sequence: Synthetic polynucleotide
gtggatagtttgaatgtattgtagaagtatttgtttattagtgggttttattgttgggtataggtttgtgtgtttagggtagagtgtttggtgtatgttgtggagggtgtgggtaatggtgtatattgtattaattataaattgtattttgtttttttgtttgtaggtggagttttggttgatgtgttttttgtttgttttagggatgtttagagaaagtgtgtttggtttttatgtattgaatttggttttttg

SEQ ID NO: 15593 - DNA, 309 bp, Artificial Sequence
  Description of Artificial Sequence: Synthetic polynucleotide
ttgtttgtgtattttggagatatagtagatgtattgttggaaggtgtatagtattattttttttagtattgttatggtttttttgttggttgttagtgtgtaggagaatagtgatttttttgagtttgttgggagatagttatgttaatggttataatgggtatagtgtttaggaatgtagtaatttagttagttgttagttttttttttggtgtgggtattatttaatgtgtttatttggggtttagatgtgataaattggttgagggattttgggttttggttgggatgagtgtagtaaatttgttg

SEQ ID NO: 15594 - DNA, 992 bp, Artificial Sequence
  Description of Artificial Sequence: Synthetic polynucleotide
ttgttttgtgtttagtagtatagtattgtgggggttagatagaggtgtttttgttttttagttggggttagttttgggttttttttttttttagattggtataggatttagattgtttattttagtatattgatttagatagttttgtggattagtttggttattttgagtaggagttgtttgaatgtgtttggttggaagtgggtggttgagtgttggatgtagaggtataggaggaaggtgggggttagtttgtggttgttgttttttggtttgattaatgttatgattttttgtagtagtgtgttttttaggtggggtttaaattttaggagtagttgttggtgttggggtagggtggtttgagtaggggaggtggttttttgggttttgagtgtggttttgtatagttggtagttttgtggtatagtttggaggtgtgttaaggtttgggtgggtaggggttgggtttgtgtggggtttttgaatagtagtaggtagtagagttttagggagagtaggtttttgtggtgtagtattatggttttgtgttttattttggagaagttgatggagatgtgtgttttggggatgggttttaggattagtttttttgtggtttggttgttgtttgggagtggttgttggtggatggtgtagtgtagaggtaggatgttgggggttgagaggttgatgttgggtttgttggagggggtttgttggtttattgtgtgttggttttggttgagtatatatattaggttgttttgaaatagagattttgtttagggtaggtgtaatgtgagtagtatatgggaaaagtgttttgtgtttagttattggttgttgaagtagtgtggttgggatgttgttgttatgggttttttatgtttttggttatttttatattagaattttgatggtttttaggaatttgttttttgatgtttgggtttattttagaggaggttggttttttggaggagtatatg

SEQ ID NO: 15595 - DNA, 265 bp, Artificial Sequence
  Description of Artificial Sequence: Synthetic polynucleotide
ttgtgttttgtgtttttggttttttttttttttagtgttttttttatttggtgttgtttggttgtaattttggtttttttggggaagaggtttggattttattttttatttgatatgaagaggtttggatttttagttttatttggtatgtttatgggtagtagttttattttgtttggtgtgtttatgggtagtagttttgttttatttggtgtgtttatggttagtagttttgttgtgtttggtgtgtttatgggtagttttg

SEQ ID NO: 15596 - DNA, 488 bp, Artificial Sequence
  Description of Artificial Sequence: Synthetic polynucleotide
ttggtggaggtgggtgtggtgggggaggggtttttttttttgtttttttatttttttggtaggtgttttagggtgggggtgttgttgtgtgttttggtgtgttttggttttgttattagttttattggggttttataattgtttagttgtttagtgtgtgtttggagaaagagaagtgggtgattatggagtagtgtttttattattgattgtttttttgttattgtatttatataatttgttttaaatgggtaatttattaagtatattttgtttttgtttttgttgtaggtttttgttggattgttgtttataagtttttatagtttgtgagtttttttagtttggtttggtttattttgtggtgtttatgtttattttgggttttttttgatttttttttaatttttagtagagttgtgggttttttttagttagtttttatagtgtgtttaggagattgtgtttttttttgttagatatgggtg

SEQ ID NO: 15597 - DNA, 676 bp, Artificial Sequence
  Description of Artificial Sequence: Synthetic polynucleotide
ttgttatttggatatgatggattgttttgtgttggaggatgaaggtttgtatattattgtggtgtattgtatgtagtttatttatttttatttgtgttgttgtgtttgtttgattgatgaaggtttgtgttatttggtgatttattgtgtttttattaaggagttgagtgttagtgattgttgttttgttagtgattttggtttgtgggagattgttaagttggagttttgtttgtggtatttgagtattgtgtattgtggttgggttattgatgtgggtatttgttatgtggttaagtattgtagtaagttgtgttattttaatgtgaggggttgtgagggtattatggattatggtgtggagtattttgttaagaattgtattaaatttaaatttttggatattggtaaatgttttttggtatttgatatgggtttggagtgtttggttttgaattgttttaattttaagtggtttagttttaagttttgtgagagtattattggttagggtttgtagattgtggttgttaattgttttgatttttagatgttgaatgtttaggattgtgaggtttttgtggaggttttgtgttttgttaaatgttattgtaagtgttgtgttattgagtatattaatttggtttttttttgaagggatagagtttatttggtg

SEQ ID NO: 15598 - DNA, 1238 bp, Artificial Sequence
  Description of Artificial Sequence: Synthetic polynucleotide
gtggtttaaaggtattggatgttggggttaagatgatttttgtgttgttatgaattaggttattggatgtgggttttgtgttgagtttgtagtttttgaggagttttttgggtttttttgttttgattatatttttttggatggttgttgggtttttgtttgttttgttttgtattgagttttttatgattttttttgtttttagtttgttttttttgtttttttggaagtagttgagggttggtttggggttttttaatttgattattttggaggttttaggattggttttgatggttttttgaggttttattgattgatttaggttgggttttagtttttgttttttggttttgatatgtagtgttaggggttgtattgggtgtaatttgggtttggaggtggtgttgtttgatgttgttggtggttgtaggagttgtaggttgggtttgaattgtaatagttgtgtttgtgtggatgaggtagtggtttttttgttttgggtttgaggttgtggtagtagtaatatttgttttggttttatttgtagtagttgttgtattgtgggttgtaagttggatgttattgtttttttgtatgatgaggttaaggttgtattggttgttgtgtttagtgtgggagatgatggagggggttttatggttgttgtttaaaaggaggtgtttttgattggtagtgggggtggagtgggatgtaatgggtgtggttgaggtggtggtttgggtttggttttttttatgggggagggggatgttttggttaggattgtgagtttagttgtttgttggtgatttttttttttttttttttggttaagagttttgtaaggtttttgttatttagaattttatgtggtttaaaatgtagttgtttgtttgggttttatttaattataatgattgatatttgtggatggttaattataggtgggttttttggttttttttggtttttatttttgttttgtgttgagtttttgaattatttgttatggtaggagttgttgtatttgttgtatatttttgttttgatttttttgtggagtttttttatagttgttgtttttagttattttttttttatttggagttgtgataatggtgttgtttaggaaatgttgtgtttttaggttgttgatatttagggaatgaagttttgtgttataaggggagtgatggttttgtgtatgtgttttgtgtggtttgagtaatttgttg

SEQ ID NO: 15599 - DNA, 220 bp, Artificial Sequence
  Description of Artificial Sequence: Synthetic polynucleotide
atgtttattgttttgtaggtagttttagtttgagtggtggttgtgttgggtttgtgtttggggtttttttttgtatgtttttgttttttagtgtttgtgatgatgtgtgatttattaattatttggatttagtgtatttttatgttaaatagtgtgtgtttatttgtaaagtatatgatagtttttgtggttattgggtgttggtgtttagtttgttttg

SEQ ID NO: 15600 - DNA, 631 bp, Artificial Sequence
  Description of Artificial Sequence: Synthetic polynucleotide
gtggtgaggggtgattttggaggaggtagagttttgggtgtttgtgggaagttttaaagttgggttgtgggatggttattttgggttgtgatgtagtttaggatttttgttaaggtatttgttggaggttttttttgggttttatgattttgattgtgtttgttggttgttagtgaggaggtggggttaaggtgagggtggggttgaggtaggaggggtggggttggtttgatgggtggggtttttgtgtgggtggggttgttggttttgtggtttgagttagtggggagaggtttgggtggaggaggttgtggatttttagaggtttagtgttggaagttgggtttggaaagggggtattgtttttttggttttggtggtggggagtgaggggatgggtgaaagtggtatagggaatagtatgatatgggtttgaggtagggtatatttggaaaggggtgaggagagggtagtggtttttggtatggtagtagtgggtatatagaggtagttgggatttgtttggaagagtttttgtttggggtaaggagttgggattgtgtttaggaggtagtggggagttttggagagtgaagtgttttttgtgtagatttgtgtgtttggagtattg

SEQ ID NO: 15601 - DNA, 904 bp, Artificial Sequence
  Description of Artificial Sequence: Synthetic polynucleotide
atggtgtttgttttttgtttttggagtgtttttggtttaatgtagtagttttgtagataaatgttatagaaggtagagtgttttatagatatgaaggagtggtttgtggttttatgtagaataaattatttttggtagaaagattaggaaagttttgaaattgtggagtttttaagggatgggtagaatgggtgggtgagtagggttaagtgttttttggatagtgattattttggagtttggggatgtgttggggggtaggagttgttttatttgtttaggtgagggtttgggaagggattttaagtgggaggttgatgttgtttgggtttttttttggggtggttgtttttttatttattttgagtattttgaaatttggaaaggagtaaagttgaagtgatggttatgtgtatgatggtaggtagtttgtagatttgttgttaaattatatttatgttgggtttaataggtgtgtatttgttggtatgttgtttgttgttgtgatttgggtagtgttgggttttaggtttttgttttttgtgttgtgatagtgagaagttgagaaagttatgttatgtttgtttgaggaggtagttttttagtgtggtagaaagaaatgtttattttttgagtattagttaggatgtgtgtttaagttaatttgtttatttttttatttgattttttatgtaatgtaatatgtatgttttatttataaaaatgagtagtgaaatttattgatttagtaatatgttttgagatatgtaggagttttttttatggagttagtttttggtttttttttttaatatttattttgtgtttgtgtagtttgggtttttgttattgtgttgttagttgggtggtattttttaggtggggaaaagtgaattttttgttg

SEQ ID NO: 15602 - DNA, 519 bp, Artificial Sequence
  Description of Artificial Sequence: Synthetic polynucleotide
atgttattttttgggggtgtggtggggttgggtagggagtgtggtgtgtgtttgatatttatggttggtttttttttgttttttatagttgtttatggtggataatggggttgatgattggtgtattgttatgatttgtgagtgtgtgttttttattttgttagagttggtagtgtgtgttatttatttggtgtttggttattattgttttatgtggatggtgtggttggtttttatgtatgtgtttttggtggttgaggttgatgtggatgtgttgttgtttatttttatgtttttgtgtttttatttgttgggttgggtgatgttattgtatagtaaaatttttatggatgttttgagttgtagtattggggtttttaataagattatttttaatatgtgttttgttatgaagatatttatgattatttgttttggtattgtgttgttggtttttagtatttttttttggattattgtagtttggattgtgtgtgtttgtgagaggtgtgattgttg

SEQ ID NO: 15603 - DNA, 204 bp, Artificial Sequence
  Description of Artificial Sequence: Synthetic polynucleotide
ttgttgttagtttagttgtttgttattttttttagtggtgtttttgttattaatgggttttttataattgatttggtttatgggttgtagatgttgtggattattggtgtggggaagtatgagtttattgatttggggtattttagaggtaagttttgttgttatgtgtttttttatgggtttgtgtttgtatttttttgtgtg

SEQ ID NO: 15604 - DNA, 444 bp, Artificial Sequence
  Description of Artificial Sequence: Synthetic polynucleotide
ttggtttttgtgtagatggatgtgaggaatgttattgtttttttttttttttttgttgttggtgttatgtaggagttggttattttttgttggtagtgttgtgttttggggaatttgatgggtttttataggttggtgggggtggagataggggagatgaagaaggagggggtagtttgtttaggaggttaggggggtatttgtgtttggtttaggtttattgatgtagatattattgatatttatgtttgtgttgtgttttttgtggtgtttgtggttgttaatgttatttattgggtggtatatgttatgtgagtataggatttaggttatttttgtttgttttggtgtttggtggtagttgtttagaaattttttgggagaaagagtttttgggttgtttttttttttgtgtgttttgaagtgggatgatagttggttatg

SEQ ID NO: 15605 - DNA, 397 bp, Artificial Sequence
  Description of Artificial Sequence: Synthetic polynucleotide
atgtgttttgtttattatgaggtttgtattttttgggtagtaggtgttgtgtgtttttgggtattttgtaggtggagttgttggtgtagtgtagtattttgtgtttttgatgttggttttggatttagttgttgttgtatttgttattgtttttgggggatatatgtatggagtttatttttaatagggggagttgggtggtggtagtgatttagattggttttttttattgggttttgtaggtattgtgggattgaggtaaaaataggtttgagtagatggttttaagagtttttgttttgttagggttagttgggggttgatgataggtggtggggatatgtttgtttatttttattttagatggtaggtttgtttgggatgtatttagtttttg

SEQ ID NO: 15606 - DNA, 1530 bp, Artificial Sequence
  Description of Artificial Sequence: Synthetic polynucleotide
atgtatggaatttttgagtttggagaatgtgttggagttttgtgtttatgtttttatttatgtggttaaggattttttgattgttagatattagggtttgtaatttgtgagtgtggttggagattttgttttttgtttgggattttgtggagttttttttagttttttgggaggttgttttgggaggtttgtgttttgagttttgtgtttttttattttttaggtgtatttgttttttgtttattttaatgattatatttgttttatttatatggagatggataataagtgtttttattgtgagtttttgttgtatttggagaggtgggtgtgtggttgggttaatgtggggtggggtgggtggggtgggatttggttttgatgttttgttgtgttttaggtttgggttttataaatatatgaagatggataaggaggagggggatgaggatgaagaagatgaggtgtagtgttgagttttttttttttttaatttggatggtgagtgtttgtagtgtttttggtttgtatttatttgtgtagggagtttttaatttgtgttttttgtagattttttggatgatgaggatgagggggagttgtttgatagtttggagtttattgaggtggttttgtttaggagtggtttttagttttttgttttagtagtttttgtttagtttggagttatttttgttttgttgatttttttttgtttttgggatggggggatttttaggtatttttgggttttgagttgggttgttagggttgtttgttttttgttgttttttttgggttgagttttgtttttgtgttttgtagtggagtagttgtttttaaaggtgtatgtgattagggtgtggttgggatagtgggtatttttttgggttttagtgttgtgtgtgttttggttgtttttttttggtgtttttttgtattttaggtttttgtttagagtgtagttgtgggtgtttttatgtttattttggttttatggttgtaggattggtggtttttaggttatatagttgaggtttttagtttgggtgtaggttatttaagggggttgggagggttaggtgtgtatgttgggatttgtggtgtttatagtggatttaaatttgttttttgaagtgtggtttgtgattttttttttgagtttgttttaggtgtttgggttgtagttgtttggggagggtgaagaggaggaggaaggggaggatgatggggttttgggtgatgaggttgtgttggaggatagtgaggaggttgtgggtttggtgtttggatgttggtgtgaggatgttattgattggtagtgtatgtttagtgtgggtgttgtggattttgagttgttgtgtttggattggaatgatttgtgatgtaatgttttggggaatttgtagttgttggaggtggaggttgtggatgtgattgtttagtatatggagtggttgaatgtgtgttatggtgggtatgggggtggttgaatgtgtgttagggtggttttggaggtggggatagttg

SEQ ID NO: 15607 - DNA, 414 bp, Artificial Sequence
  Description of Artificial Sequence: Synthetic polynucleotide
ygtgttagygttaggttggatttagygagtygtygatgttagygagatgttaggttggatttagtaagtygtygatgttagttagaygtagagtagagaaygttggttaaagagtagttaggyggtgtttgttyggtygaagtttagtttyggagaggtaggttttgtattaggaygtggaggtttyggggttatgaaatttttagggtgagagataaaggtagtgagtggtygtttagggtagaggggayggaggtagtaygyggayggagttttygtatagagygttayggttaygattggaaagtttagataygtgttaygagtttatagtttaggttagaggyggtaggatggygggyggttttatgtatagaattgyggttaygtgtggaaggygayggatattggygg

SEQ ID NO: 15608 - DNA, 987 bp, Artificial Sequence
  Description of Artificial Sequence: Synthetic polynucleotide
ygaggagttygygtttttaggattggattgatttattttgaggttgaygatgggtayggttgygyggtyggtayggygtaygatgttgtataggttttgtaggygygaggataggaaggygyggaaggtgttygttagttttayggttygygtttgttggaagtattggaagtyggtttygyggatgtttygtatgtygtttgatagggggttgttgagygtaattaggtggagttgyggggagaggggygygttaygggttgtgttttaygttgttttttgtatttaggtttygggygtattatttyggtttygtatttgtgtggataggtayggtygaggggygttgagygggaggygygtaagtgatatattgaggggtttaggtagtagtttttataygttgttaggttagagtagtttygggttaygtgggtgtttttagttgtygttgtaggyggaggtaygtyggttttttaaggatgtgatagyggttggatttttatgattattgtttggttattagagggtaagttttagggttagttaagtygttttgagtggttttgagtygttagatttttatttatggtygaagtttgggatttttagtagttttgtaggggttgggtttttttttgttgtygagagtygaggggttagatggagttaagtttattttgggggggtatttattatyggttggaagtygyggtggttgtgggygggtgggtttgtgggtygygtyggtygtaggtgtaygtaggagttgtggtgyggggtttyggggtagggttggggttygggtaggygaggggggttggttaggatgttatttgttygttagggtygygyggtggggtgggggtgttttygtygygggtaggggttgttgtygtgtagttgtattayggggggttgtaaggyggttattttattgttttgtaggtgggagaygtggggtttgtyggyggggggatttttygg

SEQ ID NO: 15609 - DNA, 1061 bp, Artificial Sequence
  Description of Artificial Sequence: Synthetic polynucleotide
yggggtagggggyggttgtygtaagggtgggattygygggtttygaggtttttttggtggtggagaygygtygaggtygtttttattttaagttttttttttaggtggtgagtyggttgggtttggattttttgtgtttttttagttttaaggagyggattatygagtgagtttttgttttttygttttttttttatttttttygggttttgtttttygggttttgyggggygttggggtttttgygtggagattyggttgagtttttttagygtttttttttgggygtttattyggtttgygttaagtyggggtttgggggttgaggggggtatagagatttyggtygggttttygtaggtttttagtygagtggttattttttygtgggtgtagaygggygtggggtttggggtygtttygggaggattgygttttttttattaatttyggttagattygttgagtygygtttattttgtaggtatttggtttttgagygygggtttgagygaggtttgggtagtaagtttttgygygttttygtgggggaggtgggtgttygttttgyggttttygggggyggttyggtggyggyggtygttgyggttatggtgagygyggggggaggggtaggggaggygtagttgttggggggagggyggggagggggaagggygttgttggggggagggtayggggtggggagggygyggtggggtygttttgggtggagaygtgggggttataygggtgggattttygtagggattattygggtttttggttttttttggggtyggtttygggtygtttggggtttttgygatttttatatttatttttttygtagggtgyggygttgggttttatggtgggttttatgatttaygggyggygttaattttagtttttggataygaygatgyggygtttgatttygttttttygygaggtttyggttaagttaattaygttggtggatgtygaygtygaggtttttatygtttatttggtgagtggyggttatagtagggtttttygggttttattaatagyga

SEQ ID NO: 15610 - DNA, 382 bp, Artificial Sequence
  Description of Artificial Sequence: Synthetic polynucleotide
yggayggtaaataygygtgggtttttygtgtgtttgayggtaaagatgtatgggttttttgtgtgtyggatggtaaataggtttygtgtgggttttttgtgtgtyggatagtaaatataygtgggttttttttgtgtyggatagtaaatataygtgggttttttttgtgtyggatagtaaataygygtgggtttttttgtgtyggatagtaaataygygtgggttttttttgtgtyggatagtaaataygygtgggtttttttgtgttaaayggtaaataygygtgggtttttygtgtgtygaatagtaaataygygtgggttttttttgtgttygatagtaaataygygtgggtttttygtgtgtyggatgataaataygt

SEQ ID NO: 15611 - DNA, 261 bp, Artificial Sequence
  Description of Artificial Sequence: Synthetic polynucleotide
ygtygattaggaggatyggtggygatttyggtttttagtgttttygatagagtgaaatggyggyggyggtygggatgatgttgttgggtttgttataggygggtgggtaggtgttgggttaggygatggaggaggtggtaggyggtaattttttgtttatgttgttgatygtttgygtttttatttttagtttggtttatttgtttygtttygttgtyggttatttggtttagttgatygtaggggygaaaagtttttygt

SEQ ID NO: 15612 - DNA, 892 bp, Artificial Sequence
  Description of Artificial Sequence: Synthetic polynucleotide
ygyggggttgtttaagygttggyggaggtygggttgggtygttgtgygtttgtttttttttttygygttttttttgtygttttaattttgttttggttaygagggagtttgtgtttaygtagatygggtagtgygggaattagatyggygttaaggttggtagtyggggttttgagggtttagttygggtttgtygggtggtyggggaagatgttggtagyggygggggyggtgtttttgtattgyggtttttgggttttttgtyggggayggtggaatygggtggttggygaggyggygggggtggattttagggatagggyggtttggggatgggggtgyggatgggggtgggagagyggttggggygttttygtgatttagtttyggtttgtttggtttttttygttttygtagttttgggaggtgatttttgatgaatatgttatygatttygttggtatttattayggggatagttatttgtagttggagygtattaaygtgtattattaygaggttagyggtgygattttygttttttttttatygtttttttgggaaygyggtttttttttygtttatgttttttygttttaygtaggtggtaggtaygtgtttygygttgtgttygtggatttggagtygggtattatggattttgtgygttyggggtttttygggtaggtttttaggttagataattttatttttygtgagttgygggygaggattggggtgyggttttttagttagggtagttygaaatttaggaaygttttaaggttattttgtgggaattgtggygttagggtttttgaatatttttttgtttttygagtygagtygttttatttgttttttaaaygggtttygggaggaaggttygygt

SEQ ID NO: 15613 - DNA, 682 bp, Artificial Sequence
  Description of Artificial Sequence: Synthetic polynucleotide
ygtttagtaggyggtattgygttttgaygtyggggatttagtatttagtygttttygttygtaggtgttttggttttgtttyggttttttttggtttgtgttttgattttgtttttygtygtttagaaygtygtagttagggyggtatataagtttygaggggyggggttygggggttttttttttattygtttttygtttttttttttgttggatttgaggygtygttttygtygygttgttttygygttatgttaygttaygttaygttaygttaygttaygtttttaygttaygtttaygttaygtttttatttttygtttatagggaaaygggtttyggygatgtgagggygtttgtygtgtttggtgtttttataggggagttttttgttttggtygyggttttaggttttgtgttgaygtagtaggagggttttygggtagtttaggtaggygayggggagtgaygagggttttttatagttatgggagtygagtttagagtaggyggtagtagygtttttgttatttttggtttaaaagtagtygtgtggggtttttgataggtgtttyggagygaattgttttttttggtttagtttttagggttttgttagggtttttgttgtttagaaggttyggggttyggttgaygattygttatatygtgggttttygg

SEQ ID NO: 15614 - DNA, 223 bp, Artificial Sequence
  Description of Artificial Sequence: Synthetic polynucleotide
ygaaaaatagaggygttgggtgygaggyggagagatgtataggtttggtttyggtttygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygt

SEQ ID NO: 15615 - DNA, 255 bp, Artificial Sequence
  Description of Artificial Sequence: Synthetic polynucleotide
ygggaggtygggttyggtgtatgggggtygggtatattttttttgggtatttttaggataggygaggaaygtatyggtygggattttatttaygagtaggagggtaaggtgtagtttgtgattgatgyggtgtaygttattgtttaygttttttatagtatgtattaggygttttgttttgggtatataggtttgtgttyggygatggaatttattgatgggyggatgtttttgtagtatattygagttgttygt

SEQ ID NO: 15616 - DNA, 309 bp, Artificial Sequence
  Description of Artificial Sequence: Synthetic polynucleotide
yggtaggtttgttgygttygttttagttagggtttagagtttttyggttagtttatygtatttggattttagatgggygygttgggtggtgttygygttagggaaagagttggyggttggttgagttgttgygtttttgagygttgtgttygttgtgattattggygtggttgtttttyggtaggttygaaggaatygttgtttttttgtaygttgayggttagygaggaggttatggyggtgttggaggaggtggtgttgtaygttttttagtagtgygtttattatgtttttaaggtgtayggaygg

SEQ ID NO: 15617 - DNA, 992 bp, Artificial Sequence
  Description of Artificial Sequence: Synthetic polynucleotide
ygtgtgttttttygggaaatygattttttttgggatgggttyggatatygaggggygggtttttgagagtygtyggggttttggtgtgggggtggttagggatatggagagttygtggygatagtattttagttaygttgttttagtaattagtgattagataygggaygtttttttygtgtgttgttygygttaygtttgttttgagyggagtttttgttttaggatagtttggtgtatgtgtttaatygggatyggtatayggtgggttagyggattttttttagtaagtttagtattagttttttagttttygatattttgtttttatattgtattattygtyggtaatygttttyggatagyggttaggtygyggggaggttggttttggagtttattttyggggygtatattttygttaattttttygaggtggggtataggatygtggtgttgtattayggggatttgttttttttggggttttattatttgttgttatttaaggatttygygtaggtttagtttttgttygttygggttttggygygttttygggttgtgtygtagagttgtyggttgtgyggggtygygttyggggttyggggagtygttttttttatttaggtygttttgtttyggygttagtagttgtttttggagtttgagttttatttggaggataygttgttgtagaggattatgaygttgatygagtyggggggygaygattataagttgattttygttttttttttgtgtttttgtatttagtattyggttatttatttttagtygggtatattygggtagtttttgtttaagatagttaggttgattygygagattgtttgggttagtgtgttggggtgggyggtttgggttttgtgtyggtttgggggaagagggggttyggagttggtttyggttgggaggygggagygtttttatttgatttttayggtgttgtgttgttgagygtagggygg

SEQ ID NO: 15618 - DNA, 265 bp, Artificial Sequence
  Description of Artificial Sequence: Synthetic polynucleotide
yggggttgttygtgaataygttaagtataayggggttgttgatygtgaataygtygaataaaatagggttgttgttygtgaataygttaaataaaatggggttgttgttygtgaatatgtygaataaaattgggagttygaatttttttatgttaaataaagagtagggttygaattttttttttaggagggttagggttgyggtygggygaygttaggtggggaagatattagaagaggagaaaattaggagygtaggaygygg

SEQ ID NO: 15619 - DNA, 488 bp, Artificial Sequence
  Description of Artificial Sequence: Synthetic polynucleotide
ygttygtgtttggygggagaggatayggttttttaggygygttgtagaagttgattggagaaggttygygattttgttgagggttaaagaggaatyggaaagggttyggggtagaygtgggygttatagggtgagtygggttaggttgagaggatttaygggttatgggagtttgtgggygayggttyggtaggggtttgyggygggaatagggataaaatatatttaataaattgtttatttagagtaagttgtgtgggtataatggygagaaaayggttagtaatggagaygttgtttygtagtygtttatttttttttttttaggygygtattggayggttgagygattgtgaggttttagtggggttggtgatagaattaaggygygtygaagygygyggtagtattttygttttagggygtttattagaggggtaaaagggtaaaagagagagttttttttttattaygttygttttygtygg

SEQ ID NO: 15620 - DNA, 676 bp, Artificial Sequence
  Description of Artificial Sequence: Synthetic polynucleotide
ygtyggatgaattttgtttttttagaagaaagtygggttggtgtgttygatgaygtagygtttgtagtggygtttgataaagygtagggtttttayggagatttygtagttttggatatttagygtttggaggttaaagtagttggyggttaygatttgtaagttttggtyggtgatgttttygtaggatttgaggttgagtygtttgaggttgaagtagtttagggttaggtattttaggttygtgtyggatattaaagggtatttgtygatatttagggatttgagtttggtgtagtttttggygaggtattttatatygtggttygtgatgttttygtagtttttygygttgaggtagygtagtttgttgtagtatttggttaygtagyggatgtttaygtyggtgattyggtygtagtgygygatgtttaggtatygtaggygggattttagtttggygatttttygtaggtygaagtygttgaygaagyggtagtygttgaygtttagttttttgatggaggygtagtagattattaggtagygtaggttttygtyggttaggyggaygtagyggygtaggtagaggtgggtgagttgygtgtagtgygtygygatggtgtgtaggttttygttttttagtaygaagtagttygttatgtttaggtagygg

SEQ ID NO: 15621 - DNA, 1238 bp, Artificial Sequence
  Description of Artificial Sequence: Synthetic polynucleotide
ygatagattatttaggtygtatagagygygtgtataaggtygtygttttttttgtgaygtaagattttattttttggatgttagyggtttggaagygtaaygttttttgggtaaygttattgtygtagtttygggtgggggagggatgattaaagataayggttgtaagagaattttataagagagttagaaygaaaatgtgtaataagtgyggyggtttttattatggtaggtgattygaggatttagtaygaggygagagtagggattaggaagagtyggaaaattygtttgtgattggtygtttaygggtatyggtygttgtgattgggtgaggtttagatagatagttgygttttgaatygygtagggttttgggtagtaaaggttttgtaaggtttttaatygaaagggggagggggaaggtygttaataaayggttgagtttataattttggtyggggygttttttttttttatggagagagttagattygagtygtygttttagtygygttygttgygtttygtttygttttygttgtyggtygagggtatttttttttgggtagtagttatggagtttttttygtygttttttatattgagygyggtagttagtgygattttggtttygtygtgyggggaggtagtggygttyggtttatagttygyggtgyggyggttgttgtaggtgaagttagagtaggtgttgttgttattatagttttaggtttagaaygaggaagtygttgtttygttygygtaggygyggttgttgtagtttaggttygatttgyggtttttgtagtygtygatagygttagayggygttatttttaggttygagttgtattyggtgtagtttttggygttgtatgttaaggttaagaagtagaagttggggtttagtttggattagttagtggggtttygaggggtygtygaaatyggttttagagtttttagggtggttaagttggaaggtttygggtyggttttyggttattttygaggggaygagaagggtaagttggaggyggaggaggttatgagagattygatgtaaggyggggtaggtaaaagttyggtagttattygagaaggtgtgattaaaayggaggaattygagagatttttygaggattgtaggttyggygyggagttygygtttaatggtttggtttatggtagygyggaggttattttggttttaaygttyggtgtttttgggtygt

SEQ ID NO: 15622 - DNA, 220 bp, Artificial Sequence
  Description of Artificial Sequence: Synthetic polynucleotide
ygggataggttgggygtyggtatttagtggtygtaggggttgtygtgtgttttgtagatggataygygttatttaatatagagatgygttgagttygggtgattagtgaatygtaygttatygtagatattagaaagygaaagtataygggggaaggtttygggtatagatttagtayggttattattygagttggagttgtttgygagaygatgagygt

SEQ ID NO: 15623 - DNA, 631 bp, Artificial Sequence
  Description of Artificial Sequence: Synthetic polynucleotide
yggtattttaagtaygygagtttgygtaggaggygtttygtttttyggagttttttattgttttttagatatagtttyggttttttatttygggyggaggtttttttagaygggtttygattgtttttgtatgtttattgttgtygtgttagaagttattgtttttttttygtttttttttaaatgtgttttgttttaggttygtgttatgttgttttttgtgtygttttygttygtttttttatttttygttattagaatygggaaggyggtgttttttttttaggtttaattttyggtattgaatttttaggagttygtagtttttttygttygggttttttttygttggtttagatygtagggttagtagtttygtttatayggaagtttygtttattaggtygatttygttttttttgtttyggtttygttttygttttggtttygttttttygttggtagtyggtaggygtagtyggggtygtgggatttaggaggggtttttagtaggtgttttggygaagattttggattgygttatagtttagggtagtygtttygyggttyggttttggagttttttayggatattyggggttttgtttttttygaaattattttttatygt

SEQ ID NO: 15624 - DNA, 904 bp, Artificial Sequence
  Description of Artificial Sequence: Synthetic polynucleotide
yggtagaagattygttttttttygtttgaaaggtgtygtttagttggtagygtaatggtaggagttygggttaygygagygyggggtggatgttggaggggaaggtygggagttggtttygtggaaaaggtttttgygtgtttyggaatatgttgttgggtyggtggatttygttgtttatttttgtggatgaaatatgtatgttatattatataagggattaggtggaagaatgaataggttggtttaagtataygttttggttggtgttyggagagtgggtatttttttttgttatattgaggagttgtttttttagayggaygtgatatgattttttyggttttttattgttatagygygagaggygggggtttgagattygaygttgtttaggttatagtagygggyggygtgtyggtaggtgygygtttgttagattyggygtgagtgtagtttaataaygaatttgtaggttgtttgtygttatgtaygtggttatygttttagttttgtttttttttaggtttygggatgttyggggtgaatggggaggyggtygttttaagggaggatttaggtagygtyggtttttygtttggggtttttttttagattttygtttgaaygagtgggatagtttttgttttttagygygtttttaggtttygggatggttattgtttaggaggygtttggttttgtttattygttygttttgtttattttttgagaatttygygatttygaaatttttttgatttttttgtyggaagtaatttgttttaygtgaaattaygggttatttttttatatttgtagagygttttattttttgtaaygtttatttgygaaattgttgygttaggttaggagtattttaagagygagaggtagaygtygt

SEQ ID NO: 15625 - DNA, 519 bp, Artificial Sequence
  Description of Artificial Sequence: Synthetic polynucleotide
yggyggtygtatttttygtagaygygtayggtttaggttgygatgatttaggaggagatgttgaagattagtagtayggtgtyggggtagatggttatgagtgtttttatgaygaagygygtgttgaaggtgattttgttgagggtttygatgttgyggttygaggygttygtgaagattttgttgtgtagtagtattattyggtttagtaggtagaggygtaggaatatggggatggatagtagtaygtttaygtyggtttyggttatygagggygygtaygtgaaggttagtygygtygtttaygtgaagyggtagtggtygggtatygggtgaatggygtatattgttagttttagygagatgaggaataygygttygtaggttatggygatgygttagttattagtttygttgtttattatgaatagttgtggagggygggagggaattagttatgggtgttagataygygtygygttttttgtttagttttatygygtttttagagagtgaygt

SEQ ID NO: 15626 - DNA, 204 bp, Artificial Sequence
  Description of Artificial Sequence: Synthetic polynucleotide
ygygtagggaggtgtagaygtaggttygtggggaggtaygtggtagtaggatttatttttggggtgtttygggtyggtgaatttatatttttttaygttaatggttygtagtatttgtagttygtgggtygagtyggttgtggggggtttattggtggtaggggtattattggggagagtggyggayggttgggttggyggygg

SEQ ID NO: 15627 - DNA, 444 bp, Artificial Sequence
  Description of Artificial Sequence: Synthetic polynucleotide
ygtggtygattgttattttatttygaaataygtagaggggaaggtagttygagggtttttttttttaggaagtttttgggtagttgtygtygggygttaggataagygagggtggtttgagttttgtgtttatatggygtatgtygtttagtagatgatattgayggtygtaaaygtygtagggaatatagygygggygtaaatgttaatggtgtttgygtygatgggtttgagtygggtayggatgtttttttggttttttgagygggttgtttttttttttttygttttttttgtttttatttttatygatttgtaggagtttattaggtttttygggaygyggygttgtyggygggagatggttagtttttgygtgaygtyggtagtagagagggagaagaggataatggygttttttaygtttatttgtaygaaggtygg

SEQ ID NO: 15628 - DNA, 397 bp, Artificial Sequence
  Description of Artificial Sequence: Synthetic polynucleotide
yggaagttgagtgygtttygagtaggtttattatttagggtgggggtgggyggaygtgtttttatygtttgtygtyggtttttagttggttttggygaggtaggagtttttggggttatttgttygggtttatttttgtttyggtttygtagtgtttgyggagttyggtgggaggagtyggtttgagttattgttattattyggttttttttgttgagagtggatttygtgygtgtgttttttaggaayggtgataagtaygayggygattgggttygggatyggygttagggatayggggtgttgygttgygtygayggttttatttataaggtattygggggygygyggtatttgttgtttagagggtataggtttygtggtgggtagggygygt

SEQ ID NO: 15629 - DNA, 1530 bp, Artificial Sequence
  Description of Artificial Sequence: Synthetic polynucleotide
yggttgttttygtttttaaaatygttttggygygygttyggtygtttttatattygtygtggygygygtttagtygttttatgtattgagyggttaygtttayggttttygttttyggtagttgtaggtttttygaaaygttgtatygtaggtygttttagttygagygtagtagttygaagtttayggygtttaygttgaaygtgygttgttagtygatggygtttttaygttagygttygagygtygggttygyggttttttygttgtttttygaygyggtttygtygttyggggttttatygttttttttttttttttttttttygttttttttgggtagttgyggttyggatatttgggataagtttaggaaggaggttaygggtygygtttyggaggataagtttgagtttattgtgggygtygtaggttttagygtgygygtttggttttttyggtttttttgggtggtttgygttygggttgggggtttyggttgtgtggtttgggggtygtyggttttgyggtygtggggtyggggtgggygtgggggygttygtagttgtattttgggtagaggtttggggtgtaggaagaygttagggaagggyggttagggygtaygyggygttggggttyggggggatgttygttgtttyggtygtattttggttaygtatatttttgggggyggttgttttattgtagggygygggggyggagttyggtttaagaagagyggtaaagggygggyggttttggyggtttagtttagggttygggagtgtttgggggttttttygtttygggggyggggaggggtyggyggggygagggtggtttygggttgggygggggttgttggggygggggattgggggtygtttttgggyggggtygtttyggtgggttttaggttgtygagtagttttttttygttttygtygtttaggaagtttgygggaaaygygggttagaagttttttgygtaggtgggtgygggttaggggygttgyggatatttatygttygggttgaggaagaggaaggttyggygttgtatttygttttttttatttttattttttttttttttgtttatttttatgtatttatagaatttaaatttggggygyggyggggtattagagtygagtttygtttygtttatttygtttygtattagttyggtygygygtttatttttttagatatagyggagattygyggtagaagtatttgttgttygtttttatgtgggtgaggygagtgtagtygttgggataaaygaaggataggtatatttggggggtgggggggygtagggtttagggygyggatttttyggggyggttttttaaggggttggagaaggtttygyggagtttyggaygggagayggggtttttagtygtatttataaattgtaggttttggtatttggygatygggaagtttttgattaygtaggtgggggygtaggygtagggttttagtaygttttttaggttygaagattttatgygt

SEQ ID NO: 15630 - DNA, 414 bp, Artificial Sequence
  Description of Artificial Sequence: Synthetic polynucleotide
tgtgttagtgttaggttggatttagtgagttgttgatgttagtgagatgttaggttggatttagtaagttgttgatgttagttagatgtagagtagagaatgttggttaaagagtagttaggtggtgtttgtttggttgaagtttagttttggagaggtaggttttgtattaggatgtggaggttttggggttatgaaatttttagggtgagagataaaggtagtgagtggttgtttagggtagaggggatggaggtagtatgtggatggagtttttgtatagagtgttatggttatgattggaaagtttagatatgtgttatgagtttatagtttaggttagaggtggtaggatggtgggtggttttatgtatagaattgtggttatgtgtggaaggtgatggatattggtgg

SEQ ID NO: 15631 - DNA, 987 bp, Artificial Sequence
  Description of Artificial Sequence: Synthetic polynucleotide
tgaggagtttgtgtttttaggattggattgatttattttgaggttgatgatgggtatggttgtgtggttggtatggtgtatgatgttgtataggttttgtaggtgtgaggataggaaggtgtggaaggtgtttgttagttttatggtttgtgtttgttggaagtattggaagttggttttgtggatgttttgtatgttgtttgatagggggttgttgagtgtaattaggtggagttgtggggagaggggtgtgttatgggttgtgttttatgttgttttttgtatttaggttttgggtgtattattttggttttgtatttgtgtggataggtatggttgaggggtgttgagtgggaggtgtgtaagtgatatattgaggggtttaggtagtagtttttatatgttgttaggttagagtagttttgggttatgtgggtgtttttagttgttgttgtaggtggaggtatgttggttttttaaggatgtgatagtggttggatttttatgattattgtttggttattagagggtaagttttagggttagttaagttgttttgagtggttttgagttgttagatttttatttatggttgaagtttgggatttttagtagttttgtaggggttgggtttttttttgttgttgagagttgaggggttagatggagttaagtttattttgggggggtatttattattggttggaagttgtggtggttgtgggtgggtgggtttgtgggttgtgttggttgtaggtgtatgtaggagttgtggtgtggggttttggggtagggttggggtttgggtaggtgaggggggttggttaggatgttatttgtttgttagggttgtgtggtggggtgggggtgtttttgttgtgggtaggggttgttgttgtgtagttgtattatggggggttgtaaggtggttattttattgttttgtaggtgggagatgtggggtttgttggtggggggattttttgg

SEQ ID NO: 15632 - DNA, 1061 bp, Artificial Sequence
  Description of Artificial Sequence: Synthetic polynucleotide
tggggtagggggtggttgttgtaagggtgggatttgtgggttttgaggtttttttggtggtggagatgtgttgaggttgtttttattttaagttttttttttaggtggtgagttggttgggtttggattttttgtgtttttttagttttaaggagtggattattgagtgagtttttgtttttttgttttttttttattttttttgggttttgttttttgggttttgtggggtgttggggtttttgtgtggagatttggttgagtttttttagtgtttttttttgggtgtttatttggtttgtgttaagttggggtttgggggttgaggggggtatagagattttggttgggtttttgtaggtttttagttgagtggttatttttttgtgggtgtagatgggtgtggggtttggggttgttttgggaggattgtgttttttttattaattttggttagatttgttgagttgtgtttattttgtaggtatttggtttttgagtgtgggtttgagtgaggtttgggtagtaagtttttgtgtgtttttgtgggggaggtgggtgtttgttttgtggtttttgggggtggtttggtggtggtggttgttgtggttatggtgagtgtggggggaggggtaggggaggtgtagttgttggggggagggtggggagggggaagggtgttgttggggggagggtatggggtggggagggtgtggtggggttgttttgggtggagatgtgggggttatatgggtgggatttttgtagggattatttgggtttttggttttttttggggttggttttgggttgtttggggtttttgtgatttttatatttattttttttgtagggtgtggtgttgggttttatggtgggttttatgatttatgggtggtgttaattttagtttttggatatgatgatgtggtgtttgattttgtttttttgtgaggttttggttaagttaattatgttggtggatgttgatgttgaggtttttattgtttatttggtgagtggtggttatagtagggttttttgggttttattaatagtga

SEQ ID NO: 15633 - DNA, 382 bp, Artificial Sequence
  Description of Artificial Sequence: Synthetic polynucleotide
tggatggtaaatatgtgtgggttttttgtgtgtttgatggtaaagatgtatgggttttttgtgtgttggatggtaaataggttttgtgtgggttttttgtgtgttggatagtaaatatatgtgggttttttttgtgttggatagtaaatatatgtgggttttttttgtgttggatagtaaatatgtgtgggtttttttgtgttggatagtaaatatgtgtgggttttttttgtgttggatagtaaatatgtgtgggtttttttgtgttaaatggtaaatatgtgtgggttttttgtgtgttgaatagtaaatatgtgtgggttttttttgtgtttgatagtaaatatgtgtgggttttttgtgtgttggatgataaatatgt

SEQ ID NO: 15634 - DNA, 261 bp, Artificial Sequence
  Description of Artificial Sequence: Synthetic polynucleotide
tgttgattaggaggattggtggtgattttggtttttagtgtttttgatagagtgaaatggtggtggtggttgggatgatgttgttgggtttgttataggtgggtgggtaggtgttgggttaggtgatggaggaggtggtaggtggtaattttttgtttatgttgttgattgtttgtgtttttatttttagtttggtttatttgttttgttttgttgttggttatttggtttagttgattgtaggggtgaaaagttttttgt

SEQ ID NO: 15635 - DNA, 892 bp, Artificial Sequence
  Description of Artificial Sequence: Synthetic polynucleotide
tgtggggttgtttaagtgttggtggaggttgggttgggttgttgtgtgtttgttttttttttttgtgttttttttgttgttttaattttgttttggttatgagggagtttgtgtttatgtagattgggtagtgtgggaattagattggtgttaaggttggtagttggggttttgagggtttagtttgggtttgttgggtggttggggaagatgttggtagtggtgggggtggtgtttttgtattgtggtttttgggttttttgttggggatggtggaattgggtggttggtgaggtggtgggggtggattttagggatagggtggtttggggatgggggtgtggatgggggtgggagagtggttggggtgtttttgtgatttagttttggtttgtttggttttttttgtttttgtagttttgggaggtgatttttgatgaatatgttattgattttgttggtatttattatggggatagttatttgtagttggagtgtattaatgtgtattattatgaggttagtggtgtgatttttgttttttttttattgtttttttgggaatgtggttttttttttgtttatgtttttttgttttatgtaggtggtaggtatgtgttttgtgttgtgtttgtggatttggagttgggtattatggattttgtgtgtttggggttttttgggtaggtttttaggttagataattttattttttgtgagttgtgggtgaggattggggtgtggttttttagttagggtagtttgaaatttaggaatgttttaaggttattttgtgggaattgtggtgttagggtttttgaatatttttttgttttttgagttgagttgttttatttgttttttaaatgggttttgggaggaaggtttgtgt

SEQ ID NO: 15636 - DNA, 682 bp, Artificial Sequence
  Description of Artificial Sequence: Synthetic polynucleotide
tgtttagtaggtggtattgtgttttgatgttggggatttagtatttagttgtttttgtttgtaggtgttttggttttgttttggttttttttggtttgtgttttgattttgttttttgttgtttagaatgttgtagttagggtggtatataagttttgaggggtggggtttgggggttttttttttatttgttttttgtttttttttttgttggatttgaggtgttgtttttgttgtgttgtttttgtgttatgttatgttatgttatgttatgttatgttatgtttttatgttatgtttatgttatgtttttattttttgtttatagggaaatgggttttggtgatgtgagggtgtttgttgtgtttggtgtttttataggggagttttttgttttggttgtggttttaggttttgtgttgatgtagtaggagggtttttgggtagtttaggtaggtgatggggagtgatgagggttttttatagttatgggagttgagtttagagtaggtggtagtagtgtttttgttatttttggtttaaaagtagttgtgtggggtttttgataggtgttttggagtgaattgttttttttggtttagtttttagggttttgttagggtttttgttgtttagaaggtttggggtttggttgatgatttgttatattgtgggtttttgg

SEQ ID NO: 15637 - DNA, 223 bp, Artificial Sequence
  Description of Artificial Sequence: Synthetic polynucleotide
tgaaaaatagaggtgttgggtgtgaggtggagagatgtataggtttggttttggttttgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgt

SEQ ID NO: 15638 - DNA, 255 bp, Artificial Sequence
  Description of Artificial Sequence: Synthetic polynucleotide
tgggaggttgggtttggtgtatgggggttgggtatattttttttgggtatttttaggataggtgaggaatgtattggttgggattttatttatgagtaggagggtaaggtgtagtttgtgattgatgtggtgtatgttattgtttatgttttttatagtatgtattaggtgttttgttttgggtatataggtttgtgtttggtgatggaatttattgatgggtggatgtttttgtagtatatttgagttgtttgt

SEQ ID NO: 15639 - DNA, 309 bp, Artificial Sequence
  Description of Artificial Sequence: Synthetic polynucleotide
tggtaggtttgttgtgtttgttttagttagggtttagagttttttggttagtttattgtatttggattttagatgggtgtgttgggtggtgtttgtgttagggaaagagttggtggttggttgagttgttgtgtttttgagtgttgtgtttgttgtgattattggtgtggttgttttttggtaggtttgaaggaattgttgtttttttgtatgttgatggttagtgaggaggttatggtggtgttggaggaggtggtgttgtatgttttttagtagtgtgtttattatgtttttaaggtgtatggatgg

SEQ ID NO: 15640 - DNA, 992 bp, Artificial Sequence
  Description of Artificial Sequence: Synthetic polynucleotide
tgtgtgtttttttgggaaattgattttttttgggatgggtttggatattgaggggtgggtttttgagagttgttggggttttggtgtgggggtggttagggatatggagagtttgtggtgatagtattttagttatgttgttttagtaattagtgattagatatgggatgttttttttgtgtgttgtttgtgttatgtttgttttgagtggagtttttgttttaggatagtttggtgtatgtgtttaattgggattggtatatggtgggttagtggattttttttagtaagtttagtattagttttttagtttttgatattttgtttttatattgtattatttgttggtaattgtttttggatagtggttaggttgtggggaggttggttttggagtttatttttggggtgtatatttttgttaatttttttgaggtggggtataggattgtggtgttgtattatggggatttgttttttttggggttttattatttgttgttatttaaggattttgtgtaggtttagtttttgtttgtttgggttttggtgtgtttttgggttgtgttgtagagttgttggttgtgtggggttgtgtttggggtttggggagttgttttttttatttaggttgttttgttttggtgttagtagttgtttttggagtttgagttttatttggaggatatgttgttgtagaggattatgatgttgattgagttggggggtgatgattataagttgatttttgttttttttttgtgtttttgtatttagtatttggttatttatttttagttgggtatatttgggtagtttttgtttaagatagttaggttgatttgtgagattgtttgggttagtgtgttggggtgggtggtttgggttttgtgttggtttgggggaagagggggtttggagttggttttggttgggaggtgggagtgtttttatttgatttttatggtgttgtgttgttgagtgtagggtgg

SEQ ID NO: 15641 - DNA, 265 bp, Artificial Sequence
  Description of Artificial Sequence: Synthetic polynucleotide
tggggttgtttgtgaatatgttaagtataatggggttgttgattgtgaatatgttgaataaaatagggttgttgtttgtgaatatgttaaataaaatggggttgttgtttgtgaatatgttgaataaaattgggagtttgaatttttttatgttaaataaagagtagggtttgaattttttttttaggagggttagggttgtggttgggtgatgttaggtggggaagatattagaagaggagaaaattaggagtgtaggatgtgg

SEQ ID NO: 15642 - DNA, 488 bp, Artificial Sequence
  Description of Artificial Sequence: Synthetic polynucleotide
tgtttgtgtttggtgggagaggatatggttttttaggtgtgttgtagaagttgattggagaaggtttgtgattttgttgagggttaaagaggaattggaaagggtttggggtagatgtgggtgttatagggtgagttgggttaggttgagaggatttatgggttatgggagtttgtgggtgatggtttggtaggggtttgtggtgggaatagggataaaatatatttaataaattgtttatttagagtaagttgtgtgggtataatggtgagaaaatggttagtaatggagatgttgttttgtagttgtttatttttttttttttaggtgtgtattggatggttgagtgattgtgaggttttagtggggttggtgatagaattaaggtgtgttgaagtgtgtggtagtatttttgttttagggtgtttattagaggggtaaaagggtaaaagagagagttttttttttattatgtttgtttttgttgg

SEQ ID NO: 15643 - DNA, 676 bp, Artificial Sequence
  Description of Artificial Sequence: Synthetic polynucleotide
tgttggatgaattttgtttttttagaagaaagttgggttggtgtgtttgatgatgtagtgtttgtagtggtgtttgataaagtgtagggtttttatggagattttgtagttttggatatttagtgtttggaggttaaagtagttggtggttatgatttgtaagttttggttggtgatgtttttgtaggatttgaggttgagttgtttgaggttgaagtagtttagggttaggtattttaggtttgtgttggatattaaagggtatttgttgatatttagggatttgagtttggtgtagtttttggtgaggtattttatattgtggtttgtgatgtttttgtagttttttgtgttgaggtagtgtagtttgttgtagtatttggttatgtagtggatgtttatgttggtgatttggttgtagtgtgtgatgtttaggtattgtaggtgggattttagtttggtgattttttgtaggttgaagttgttgatgaagtggtagttgttgatgtttagttttttgatggaggtgtagtagattattaggtagtgtaggtttttgttggttaggtggatgtagtggtgtaggtagaggtgggtgagttgtgtgtagtgtgttgtgatggtgtgtaggtttttgttttttagtatgaagtagtttgttatgtttaggtagtgg

SEQ ID NO: 15644 - DNA, 1238 bp, Artificial Sequence
  Description of Artificial Sequence: Synthetic polynucleotide
tgatagattatttaggttgtatagagtgtgtgtataaggttgttgttttttttgtgatgtaagattttattttttggatgttagtggtttggaagtgtaatgttttttgggtaatgttattgttgtagttttgggtgggggagggatgattaaagataatggttgtaagagaattttataagagagttagaatgaaaatgtgtaataagtgtggtggtttttattatggtaggtgatttgaggatttagtatgaggtgagagtagggattaggaagagttggaaaatttgtttgtgattggttgtttatgggtattggttgttgtgattgggtgaggtttagatagatagttgtgttttgaattgtgtagggttttgggtagtaaaggttttgtaaggtttttaattgaaagggggagggggaaggttgttaataaatggttgagtttataattttggttggggtgttttttttttttatggagagagttagatttgagttgttgttttagttgtgtttgttgtgttttgttttgtttttgttgttggttgagggtatttttttttgggtagtagttatggagttttttttgttgttttttatattgagtgtggtagttagtgtgattttggttttgttgtgtggggaggtagtggtgtttggtttatagtttgtggtgtggtggttgttgtaggtgaagttagagtaggtgttgttgttattatagttttaggtttagaatgaggaagttgttgttttgtttgtgtaggtgtggttgttgtagtttaggtttgatttgtggtttttgtagttgttgatagtgttagatggtgttatttttaggtttgagttgtatttggtgtagtttttggtgttgtatgttaaggttaagaagtagaagttggggtttagtttggattagttagtggggttttgaggggttgttgaaattggttttagagtttttagggtggttaagttggaaggttttgggttggtttttggttatttttgaggggatgagaagggtaagttggaggtggaggaggttatgagagatttgatgtaaggtggggtaggtaaaagtttggtagttatttgagaaggtgtgattaaaatggaggaatttgagagattttttgaggattgtaggtttggtgtggagtttgtgtttaatggtttggtttatggtagtgtggaggttattttggttttaatgtttggtgtttttgggttgt

SEQ ID NO: 15645 - DNA, 220 bp, Artificial Sequence
  Description of Artificial Sequence: Synthetic polynucleotide
tgggataggttgggtgttggtatttagtggttgtaggggttgttgtgtgttttgtagatggatatgtgttatttaatatagagatgtgttgagtttgggtgattagtgaattgtatgttattgtagatattagaaagtgaaagtatatgggggaaggttttgggtatagatttagtatggttattatttgagttggagttgtttgtgagatgatgagtgt

SEQ ID NO: 15646 - DNA, 631 bp, Artificial Sequence
  Description of Artificial Sequence: Synthetic polynucleotide
tggtattttaagtatgtgagtttgtgtaggaggtgttttgttttttggagttttttattgttttttagatatagttttggttttttattttgggtggaggtttttttagatgggttttgattgtttttgtatgtttattgttgttgtgttagaagttattgttttttttttgtttttttttaaatgtgttttgttttaggtttgtgttatgttgttttttgtgttgtttttgtttgtttttttattttttgttattagaattgggaaggtggtgttttttttttaggtttaatttttggtattgaatttttaggagtttgtagttttttttgtttgggtttttttttgttggtttagattgtagggttagtagttttgtttatatggaagttttgtttattaggttgattttgttttttttgttttggttttgtttttgttttggttttgtttttttgttggtagttggtaggtgtagttggggttgtgggatttaggaggggtttttagtaggtgttttggtgaagattttggattgtgttatagtttagggtagttgttttgtggtttggttttggagttttttatggatatttggggttttgttttttttgaaattattttttattgt

SEQ ID NO: 15647 - DNA, 904 bp, Artificial Sequence
  Description of Artificial Sequence: Synthetic polynucleotide
tggtagaagatttgtttttttttgtttgaaaggtgttgtttagttggtagtgtaatggtaggagtttgggttatgtgagtgtggggtggatgttggaggggaaggttgggagttggttttgtggaaaaggtttttgtgtgttttggaatatgttgttgggttggtggattttgttgtttatttttgtggatgaaatatgtatgttatattatataagggattaggtggaagaatgaataggttggtttaagtatatgttttggttggtgtttggagagtgggtatttttttttgttatattgaggagttgtttttttagatggatgtgatatgatttttttggttttttattgttatagtgtgagaggtgggggtttgagatttgatgttgtttaggttatagtagtgggtggtgtgttggtaggtgtgtgtttgttagatttggtgtgagtgtagtttaataatgaatttgtaggttgtttgttgttatgtatgtggttattgttttagttttgtttttttttaggttttgggatgtttggggtgaatggggaggtggttgttttaagggaggatttaggtagtgttggttttttgtttggggtttttttttagatttttgtttgaatgagtgggatagtttttgttttttagtgtgtttttaggttttgggatggttattgtttaggaggtgtttggttttgtttatttgtttgttttgtttattttttgagaattttgtgattttgaaatttttttgatttttttgttggaagtaatttgttttatgtgaaattatgggttatttttttatatttgtagagtgttttattttttgtaatgtttatttgtgaaattgttgtgttaggttaggagtattttaagagtgagaggtagatgttgt

SEQ ID NO: 15648 - DNA, 519 bp, Artificial Sequence
  Description of Artificial Sequence: Synthetic polynucleotide
tggtggttgtattttttgtagatgtgtatggtttaggttgtgatgatttaggaggagatgttgaagattagtagtatggtgttggggtagatggttatgagtgtttttatgatgaagtgtgtgttgaaggtgattttgttgagggttttgatgttgtggtttgaggtgtttgtgaagattttgttgtgtagtagtattatttggtttagtaggtagaggtgtaggaatatggggatggatagtagtatgtttatgttggttttggttattgagggtgtgtatgtgaaggttagttgtgttgtttatgtgaagtggtagtggttgggtattgggtgaatggtgtatattgttagttttagtgagatgaggaatatgtgtttgtaggttatggtgatgtgttagttattagttttgttgtttattatgaatagttgtggagggtgggagggaattagttatgggtgttagatatgtgttgtgttttttgtttagttttattgtgtttttagagagtgatgt

SEQ ID NO: 15649 - DNA, 204 bp, Artificial Sequence
  Description of Artificial Sequence: Synthetic polynucleotide
tgtgtagggaggtgtagatgtaggtttgtggggaggtatgtggtagtaggatttatttttggggtgttttgggttggtgaatttatatttttttatgttaatggtttgtagtatttgtagtttgtgggttgagttggttgtggggggtttattggtggtaggggtattattggggagagtggtggatggttgggttggtggtgg

SEQ ID NO: 15650 - DNA, 444 bp, Artificial Sequence
  Description of Artificial Sequence: Synthetic polynucleotide
tgtggttgattgttattttattttgaaatatgtagaggggaaggtagtttgagggtttttttttttaggaagtttttgggtagttgttgttgggtgttaggataagtgagggtggtttgagttttgtgtttatatggtgtatgttgtttagtagatgatattgatggttgtaaatgttgtagggaatatagtgtgggtgtaaatgttaatggtgtttgtgttgatgggtttgagttgggtatggatgtttttttggttttttgagtgggttgttttttttttttttgttttttttgtttttatttttattgatttgtaggagtttattaggttttttgggatgtggtgttgttggtgggagatggttagtttttgtgtgatgttggtagtagagagggagaagaggataatggtgttttttatgtttatttgtatgaaggttgg

SEQ ID NO: 15651 - DNA, 397 bp, Artificial Sequence
  Description of Artificial Sequence: Synthetic polynucleotide
tggaagttgagtgtgttttgagtaggtttattatttagggtgggggtgggtggatgtgtttttattgtttgttgttggtttttagttggttttggtgaggtaggagtttttggggttatttgtttgggtttatttttgttttggttttgtagtgtttgtggagtttggtgggaggagttggtttgagttattgttattatttggttttttttgttgagagtggattttgtgtgtgtgttttttaggaatggtgataagtatgatggtgattgggtttgggattggtgttagggatatggggtgttgtgttgtgttgatggttttatttataaggtatttgggggtgtgtggtatttgttgtttagagggtataggttttgtggtgggtagggtgtgt

SEQ ID NO: 15652 - DNA, 1530 bp, Artificial Sequence
  Description of Artificial Sequence: Synthetic polynucleotide
tggttgtttttgtttttaaaattgttttggtgtgtgtttggttgtttttatatttgttgtggtgtgtgtttagttgttttatgtattgagtggttatgtttatggtttttgtttttggtagttgtaggttttttgaaatgttgtattgtaggttgttttagtttgagtgtagtagtttgaagtttatggtgtttatgttgaatgtgtgttgttagttgatggtgtttttatgttagtgtttgagtgttgggtttgtggtttttttgttgttttttgatgtggttttgttgtttggggttttattgtttttttttttttttttttttttgttttttttgggtagttgtggtttggatatttgggataagtttaggaaggaggttatgggttgtgttttggaggataagtttgagtttattgtgggtgttgtaggttttagtgtgtgtgtttggtttttttggtttttttgggtggtttgtgtttgggttgggggttttggttgtgtggtttgggggttgttggttttgtggttgtggggttggggtgggtgtgggggtgtttgtagttgtattttgggtagaggtttggggtgtaggaagatgttagggaagggtggttagggtgtatgtggtgttggggtttggggggatgtttgttgttttggttgtattttggttatgtatatttttgggggtggttgttttattgtagggtgtgggggtggagtttggtttaagaagagtggtaaagggtgggtggttttggtggtttagtttagggtttgggagtgtttgggggtttttttgttttgggggtggggaggggttggtggggtgagggtggttttgggttgggtgggggttgttggggtgggggattgggggttgtttttgggtggggttgttttggtgggttttaggttgttgagtagtttttttttgtttttgttgtttaggaagtttgtgggaaatgtgggttagaagttttttgtgtaggtgggtgtgggttaggggtgttgtggatatttattgtttgggttgaggaagaggaaggtttggtgttgtattttgttttttttatttttattttttttttttttgtttatttttatgtatttatagaatttaaatttggggtgtggtggggtattagagttgagttttgttttgtttattttgttttgtattagtttggttgtgtgtttatttttttagatatagtggagatttgtggtagaagtatttgttgtttgtttttatgtgggtgaggtgagtgtagttgttgggataaatgaaggataggtatatttggggggtgggggggtgtagggtttagggtgtggattttttggggtggttttttaaggggttggagaaggttttgtggagttttggatgggagatggggtttttagttgtatttataaattgtaggttttggtatttggtgattgggaagtttttgattatgtaggtgggggtgtaggtgtagggttttagtatgttttttaggtttgaagattttatgtgt

SEQ ID NO: 15653 - DNA, 2 bp, Homo sapiens
cg

SEQ ID NO: 15654 - DNA, 9 bp, Homo sapiens
cgaatggcg

SEQ ID NO: 15655 - DNA, 36 bp, Homo sapiens; identical to SEQ ID NO: 12683

SEQ ID NO: 15656 - DNA, 8 bp, Homo sapiens
cgacggcg

SEQ ID NO: 15657 - DNA, 181 bp, Homo sapiens; identical to SEQ ID NO: 12705

SEQ ID NO: 15658 - DNA, 369 bp, Homo sapiens; identical to SEQ ID NO: 12716

SEQ ID NO: 15659 - DNA, 2 bp, Homo sapiens
cg

SEQ ID NO: 15660 - DNA, 35 bp, Homo sapiens; identical to SEQ ID NO: 12738

SEQ ID NO: 15661 - DNA, 487 bp, Homo sapiens; identical to SEQ ID NO: 12749

SEQ ID NO: 15662 - DNA, 28 bp, Homo sapiens
cgtcttgatctcctgacctcgtgatccg

SEQ ID NO: 15663 - DNA, 2 bp, Homo sapiens
cg

SEQ ID NO: 15664 - DNA, 18 bp, Homo sapiens
cgcgccttcctgaccgcg

SEQ ID NO: 15665 - DNA, 18 bp, Homo sapiens
cgcaggtcagtgagtgcg

SEQ ID NO: 15666 - DNA, 87 bp, Homo sapiens; identical to SEQ ID NO: 12794

SEQ ID NO: 15667 - DNA, 11 bp, Homo sapiens
cggagcttgcg

SEQ ID NO: 15668 - DNA, 2 bp, Homo sapiens
cg

SEQ ID NO: 15669 - DNA, 167 bp, Homo sapiens; identical to SEQ ID NO: 12825

SEQ ID NO: 15670 - DNA, 2 bp, Homo sapiens
cg

SEQ ID NO: 15671 - DNA, 2 bp, Homo sapiens
cg

SEQ ID NO: 15672 - DNA, 2 bp, Homo sapiens
cg

SEQ ID NO: 15673 - DNA, 185 bp, Homo sapiens; identical to SEQ ID NO: 12829

SEQ ID NO: 15674 - DNA, 17 bp, Homo sapiens
cgagccgaagcagggcg

SEQ ID NO: 15675 - DNA, 135 bp, Homo sapiens; identical to SEQ ID NO: 12831

SEQ ID NO: 15676 - DNA, 2 bp, Homo sapiens
cg

SEQ ID NO: 15677 - DNA, 71 bp, Homo sapiens; identical to SEQ ID NO: 12833

SEQ ID NO: 15678 - DNA, 54 bp, Homo sapiens; identical to SEQ ID NO: 12834

SEQ ID NO: 15679 - DNA, 5 bp, Homo sapiens
cggcg

SEQ ID NO: 15680 - DNA, 29 bp, Homo sapiens
cgccggtttttaagcccgtaggaaaagcg

SEQ ID NO: 15681 - DNA, 18 bp, Homo sapiens
cgctttctagtgtctgcg

SEQ ID NO: 15682 - DNA, 2 bp, Homo sapiens
cg

SEQ ID NO: 15683 - DNA, 5 bp, Homo sapiens
cgacg

SEQ ID NO: 15684 - DNA, 24 bp, Homo sapiens
cgaagcgcctcctgcgcagactcg

SEQ ID NO: 15685 - DNA, 2 bp, Homo sapiens
cg

SEQ ID NO: 15686 - DNA, 4 bp, Homo sapiens
cgcg

SEQ ID NO: 15687 - DNA, 2 bp, Homo sapiens
cg

SEQ ID NO: 15688 - DNA, 12 bp, Homo sapiens
cggggcaggtcg

SEQ ID NO: 15689 - DNA, 2 bp, Homo sapiens
cg

SEQ ID NO: 15690 - DNA, 80 bp, Homo sapiens; identical to SEQ ID NO: 12875

SEQ ID NO: 15691 - DNA, 4 bp, Homo sapiens
cgcg

SEQ ID NO: 15692 - DNA, 3039 bp, Homo sapiens; identical to SEQ ID NO: 12897

SEQ ID NO: 15693 - DNA, 2 bp, Homo sapiens
cg

SEQ ID NO: 15694 - DNA, 9 bp, Homo sapiens
cgccattcg

SEQ ID NO: 15695 - DNA, 36 bp, Homo sapiens; identical to SEQ ID NO: 12920

SEQ ID NO: 15696 - DNA, 8 bp, Homo sapiens
cgccgtcg

SEQ ID NO: 15697 - DNA, 181 bp, Homo sapiens; identical to SEQ ID NO: 12942

SEQ ID NO: 15698 - DNA, 369 bp, Homo sapiens; identical to SEQ ID NO: 12953

SEQ ID NO: 15699 - DNA, 2 bp, Homo sapiens
cg

SEQ ID NO: 15700 - DNA, 35 bp, Homo sapiens; identical to SEQ ID NO: 12975

SEQ ID NO: 15701 - DNA, 487 bp, Homo sapiens; identical to SEQ ID NO: 12986

SEQ ID NO: 15702 - DNA, 28 bp, Homo sapiens
cggatcacgaggtcaggagatcaagacg

SEQ ID NO: 15703 - DNA, 2 bp, Homo sapiens
cg

SEQ ID NO: 15704 - DNA, 18 bp, Homo sapiens
cgcggtcaggaaggcgcg

SEQ ID NO: 15705 - DNA, 18 bp, Homo sapiens
cgcactcactgacctgcg

SEQ ID NO: 15706 - DNA, 87 bp, Homo sapiens; identical to SEQ ID NO: 13031

SEQ ID NO: 15707 - DNA, 11 bp, Homo sapiens
cgcaagctccg

SEQ ID NO: 15708 - DNA, 2 bp, Homo sapiens
cg

SEQ ID NO: 15709 - DNA, 167 bp, Homo sapiens; identical to SEQ ID NO: 13062

SEQ ID NO: 15710 - DNA, 2 bp, Homo sapiens
cg

SEQ ID NO: 15711 - DNA, 2 bp, Homo sapiens
cg

SEQ ID NO: 15712 - DNA, 2 bp, Homo sapiens
cg

SEQ ID NO: 15713 - DNA, 185 bp, Homo sapiens; identical to SEQ ID NO: 13066

SEQ ID NO: 15714 - DNA, 17 bp, Homo sapiens
cgccctgcttcggctcg

SEQ ID NO: 15715 - DNA, 135 bp, Homo sapiens; identical to SEQ ID NO: 13068

SEQ ID NO: 15716 - DNA, 2 bp, Homo sapiens
cg

SEQ ID NO: 15717 - DNA, 71 bp, Homo sapiens; identical to SEQ ID NO: 13070

SEQ ID NO: 15718 - DNA, 54 bp, Homo sapiens; identical to SEQ ID NO: 13071

SEQ ID NO: 15719 - DNA, 5 bp, Homo sapiens
cgccg

SEQ ID NO: 15720 - DNA, 29 bp, Homo sapiens
cgcttttcctacgggcttaaaaaccggcg

SEQ ID NO: 15721 - DNA, 18 bp, Homo sapiens
cgcagacactagaaagcg

SEQ ID NO: 15722 - DNA, 2 bp, Homo sapiens
cg

SEQ ID NO: 15723 - DNA, 5 bp, Homo sapiens
cgtcg

SEQ ID NO: 15724 - DNA, 24 bp, Homo sapiens
cgagtctgcgcaggaggcgcttcg

SEQ ID NO: 15725 - DNA, 2 bp, Homo sapiens
cg

SEQ ID NO: 15726 - DNA, 4 bp, Homo sapiens
cgcg

SEQ ID NO: 15727 - DNA, 2 bp, Homo sapiens
cg

SEQ ID NO: 15728 - DNA, 12 bp, Homo sapiens
cgacctgccccg

SEQ ID NO: 15729 - DNA, 2 bp, Homo sapiens
cg

SEQ ID NO: 15730 - DNA, 80 bp, Homo sapiens; identical to SEQ ID NO: 13112

SEQ ID NO: 15731 - DNA, 4 bp, Homo sapiens
cgcg

SEQ ID NO: 15732 - DNA, 3039 bp, Homo sapiens; identical to SEQ ID NO: 13134

SEQ ID NO: 15733 - DNA, 2 bp, Artificial Sequence
  Description of Artificial Sequence: Synthetic oligonucleotide
yg

SEQ ID NO: 15734 - DNA, 9 bp, Artificial Sequence
  Description of Artificial Sequence: Synthetic oligonucleotide
ygaatggyg

SEQ ID NO: 15735 - DNA, 36 bp, Artificial Sequence; identical to SEQ ID NO: 13157
  Description of Artificial Sequence: Synthetic oligonucleotide

SEQ ID NO: 15736 - DNA, 8 bp, Artificial Sequence
  Description of Artificial Sequence: Synthetic oligonucleotide
ygayggyg

SEQ ID NO: 15737 - DNA, 181 bp, Artificial Sequence; identical to SEQ ID NO: 13179
  Description of Artificial Sequence: Synthetic polynucleotide

SEQ ID NO: 15738 - DNA, 369 bp, Artificial Sequence; identical to SEQ ID NO: 13190
  Description of Artificial Sequence: Synthetic polynucleotide

SEQ ID NO: 15739 - DNA, 2 bp, Artificial Sequence
  Description of Artificial Sequence: Synthetic oligonucleotide
yg

SEQ ID NO: 15740 - DNA, 35 bp, Artificial Sequence; identical to SEQ ID NO: 13212
  Description of Artificial Sequence: Synthetic oligonucleotide

SEQ ID NO: 15741 - DNA, 487 bp, Artificial Sequence; identical to SEQ ID NO: 13223
  Description of Artificial Sequence: Synthetic polynucleotide

SEQ ID NO: 15742 - DNA, 28 bp, Artificial Sequence
  Description of Artificial Sequence: Synthetic oligonucleotide
ygttttgattttttgatttygtgattyg

SEQ ID NO: 15743 - DNA, 2 bp, Artificial Sequence
  Description of Artificial Sequence: Synthetic oligonucleotide
yg

SEQ ID NO: 15744 - DNA, 18 bp, Artificial Sequence
  Description of Artificial Sequence: Synthetic oligonucleotide
ygygtttttttgatygyg

SEQ ID NO: 15745 - DNA, 18 bp, Artificial Sequence
  Description of Artificial Sequence: Synthetic oligonucleotide
ygtaggttagtgagtgyg

SEQ ID NO: 15746 - DNA, 87 bp, Artificial Sequence; identical to SEQ ID NO: 13268
  Description of Artificial Sequence: Synthetic oligonucleotide

SEQ ID NO: 15747 - DNA, 11 bp, Artificial Sequence
  Description of Artificial Sequence: Synthetic oligonucleotide
yggagtttgyg

SEQ ID NO: 15748 - DNA, 2 bp, Artificial Sequence
  Description of Artificial Sequence: Synthetic oligonucleotide
yg

SEQ ID NO: 15749 - DNA, 167 bp, Artificial Sequence; identical to SEQ ID NO: 13299
  Description of Artificial Sequence: Synthetic polynucleotide

SEQ ID NO: 15750 - DNA, 2 bp, Artificial Sequence
  Description of Artificial Sequence: Synthetic oligonucleotide
yg

SEQ ID NO: 15751 - DNA, 2 bp, Artificial Sequence
  Description of Artificial Sequence: Synthetic oligonucleotide
yg

SEQ ID NO: 15752 - DNA, 2 bp, Artificial Sequence
  Description of Artificial Sequence: Synthetic oligonucleotide
yg

SEQ ID NO: 15753 - DNA, 185 bp, Artificial Sequence; identical to SEQ ID NO: 13303
  Description of Artificial Sequence: Synthetic polynucleotide

SEQ ID NO: 15754 - DNA, 17 bp, Artificial Sequence
  Description of Artificial Sequence: Synthetic oligonucleotide
ygagtygaagtagggyg

SEQ ID NO: 15755 - DNA, 135 bp, Artificial Sequence; identical to SEQ ID NO: 13305
  Description of Artificial Sequence: Synthetic polynucleotide

SEQ ID NO: 15756 - DNA, 2 bp, Artificial Sequence
  Description of Artificial Sequence: Synthetic oligonucleotide
yg

SEQ ID NO: 15757 - DNA, 71 bp, Artificial Sequence; identical to SEQ ID NO: 13307
  Description of Artificial Sequence: Synthetic oligonucleotide

SEQ ID NO: 15758 - DNA, 54 bp, Artificial Sequence; identical to SEQ ID NO: 13308
  Description of Artificial Sequence: Synthetic oligonucleotide

SEQ ID NO: 15759 - DNA, 5 bp, Artificial Sequence
  Description of Artificial Sequence: Synthetic oligonucleotide
yggyg

SEQ ID NO: 15760 - DNA, 29 bp, Artificial Sequence
  Description of Artificial Sequence: Synthetic oligonucleotide
ygtyggtttttaagttygtaggaaaagyg

SEQ ID NO: 15761 - DNA, 18 bp, Artificial Sequence
  Description of Artificial Sequence: Synthetic oligonucleotide
ygttttttagtgtttgyg

SEQ ID NO: 15762 - DNA, 2 bp, Artificial Sequence
  Description of Artificial Sequence: Synthetic oligonucleotide
yg

SEQ ID NO: 15763 - DNA, 5 bp, Artificial Sequence
  Description of Artificial Sequence: Synthetic oligonucleotide
ygayg

SEQ ID NO: 15764 - DNA, 24 bp, Artificial Sequence
  Description of Artificial Sequence: Synthetic oligonucleotide
ygaagygttttttgygtagattyg

SEQ ID NO: 15765 - DNA, 2 bp, Artificial Sequence
  Description of Artificial Sequence: Synthetic oligonucleotide
yg

SEQ ID NO: 15766 - DNA, 4 bp, Artificial Sequence
  Description of Artificial Sequence: Synthetic oligonucleotide
ygyg

SEQ ID NO: 15767 - DNA, 2 bp, Artificial Sequence
  Description of Artificial Sequence: Synthetic oligonucleotide
yg

SEQ ID NO: 15768 - DNA, 12 bp, Artificial Sequence
  Description of Artificial Sequence: Synthetic oligonucleotide
yggggtaggtyg

SEQ ID NO: 15769 - DNA, 2 bp, Artificial Sequence
  Description of Artificial Sequence: Synthetic oligonucleotide
yg

SEQ ID NO: 15770 - DNA, 80 bp, Artificial Sequence; identical to SEQ ID NO: 13349
  Description of Artificial Sequence: Synthetic oligonucleotide

SEQ ID NO: 15771 - DNA, 4 bp, Artificial Sequence
  Description of Artificial Sequence: Synthetic oligonucleotide
ygyg

SEQ ID NO: 15772 - DNA, 3039 bp, Artificial Sequence; identical to SEQ ID NO: 13371
  Description of Artificial Sequence: Synthetic polynucleotide

SEQ ID NO: 15773 - DNA, 2 bp, Artificial Sequence
  Description of Artificial Sequence: Synthetic oligonucleotide
tg

SEQ ID NO: 15774 - DNA, 9 bp, Artificial Sequence
  Description of Artificial Sequence: Synthetic oligonucleotide
tgaatggtg

SEQ ID NO: 15775 - DNA, 36 bp, Artificial Sequence; identical to SEQ ID NO: 13394
  Description of Artificial Sequence: Synthetic oligonucleotide

SEQ ID NO: 15776 - DNA, 8 bp, Artificial Sequence
  Description of Artificial Sequence: Synthetic oligonucleotide
tgatggtg

SEQ ID NO: 15777 - DNA, 181 bp, Artificial Sequence; identical to SEQ ID NO: 13416
  Description of Artificial Sequence: Synthetic polynucleotide

SEQ ID NO: 15778 - DNA, 369 bp, Artificial Sequence; identical to SEQ ID NO: 13427
  Description of Artificial Sequence: Synthetic polynucleotide

SEQ ID NO: 15779 - DNA, 2 bp, Artificial Sequence
  Description of Artificial Sequence: Synthetic oligonucleotide
tg

SEQ ID NO: 15780 - DNA, 35 bp, Artificial Sequence; identical to SEQ ID NO: 13449
  Description of Artificial Sequence: Synthetic oligonucleotide

SEQ ID NO: 15781 - DNA, 487 bp, Artificial Sequence; identical to SEQ ID NO: 13460
  Description of Artificial Sequence: Synthetic polynucleotide

SEQ ID NO: 15782 - DNA, 28 bp, Artificial Sequence
  Description of Artificial Sequence: Synthetic oligonucleotide
tgttttgattttttgattttgtgatttg

SEQ ID NO: 15783 - DNA, 2 bp, Artificial Sequence
  Description of Artificial Sequence: Synthetic oligonucleotide
tg

SEQ ID NO: 15784 - DNA, 18 bp, Artificial Sequence
  Description of Artificial Sequence: Synthetic oligonucleotide
tgtgtttttttgattgtg

SEQ ID NO: 15785 - DNA, 18 bp, Artificial Sequence
  Description of Artificial Sequence: Synthetic oligonucleotide
tgtaggttagtgagtgtg

SEQ ID NO: 15786 - DNA, 87 bp, Artificial Sequence; identical to SEQ ID NO: 13505
  Description of Artificial Sequence: Synthetic oligonucleotide

SEQ ID NO: 15787 - DNA, 11 bp, Artificial Sequence
  Description of Artificial Sequence: Synthetic oligonucleotide
tggagtttgtg

SEQ ID NO: 15788 - DNA, 2 bp, Artificial Sequence
  Description of Artificial Sequence: Synthetic oligonucleotide
tg

SEQ ID NO: 15789 - DNA, 167 bp, Artificial Sequence; identical to SEQ ID NO: 13536
  Description of Artificial Sequence: Synthetic polynucleotide

SEQ ID NO: 15790 - DNA, 2 bp, Artificial Sequence
  Description of Artificial Sequence: Synthetic oligonucleotide
tg

SEQ ID NO: 15791 - DNA, 2 bp, Artificial Sequence
  Description of Artificial Sequence: Synthetic oligonucleotide
tg

SEQ ID NO: 15792 - DNA, 2 bp, Artificial Sequence
  Description of Artificial Sequence: Synthetic oligonucleotide
tg

SEQ ID NO: 15793 - DNA, 185 bp, Artificial Sequence; identical to SEQ ID NO: 13540
  Description of Artificial Sequence: Synthetic polynucleotide

SEQ ID NO: 15794 - DNA, 17 bp, Artificial Sequence
  Description of Artificial Sequence: Synthetic oligonucleotide
tgagttgaagtagggtg

SEQ ID NO: 15795 - DNA, 135 bp, Artificial Sequence; identical to SEQ ID NO: 13542
  Description of Artificial Sequence: Synthetic polynucleotide

SEQ ID NO: 15796 - DNA, 2 bp, Artificial Sequence
  Description of Artificial Sequence: Synthetic oligonucleotide
tg

SEQ ID NO: 15797 - DNA, 71 bp, Artificial Sequence; identical to SEQ ID NO: 13544
  Description of Artificial Sequence: Synthetic oligonucleotide

SEQ ID NO: 15798 - DNA, 54 bp, Artificial Sequence; identical to SEQ ID NO: 13545
  Description of Artificial Sequence: Synthetic oligonucleotide

SEQ ID NO: 15799 - DNA, 5 bp, Artificial Sequence
  Description of Artificial Sequence: Synthetic oligonucleotide
tggtg

SEQ ID NO: 15800 - DNA, 29 bp, Artificial Sequence
  Description of Artificial Sequence: Synthetic oligonucleotide
tgttggtttttaagtttgtaggaaaagtg

SEQ ID NO: 15801 - DNA, 18 bp, Artificial Sequence
  Description of Artificial Sequence: Synthetic oligonucleotide
tgttttttagtgtttgtg

SEQ ID NO: 15802 - DNA, 2 bp, Artificial Sequence
  Description of Artificial Sequence: Synthetic oligonucleotide
tg

SEQ ID NO: 15803 - DNA, 5 bp, Artificial Sequence
  Description of Artificial Sequence: Synthetic oligonucleotide
tgatg

SEQ ID NO: 15804 - DNA, 24 bp, Artificial Sequence
  Description of Artificial Sequence: Synthetic oligonucleotide
tgaagtgttttttgtgtagatttg

SEQ ID NO: 15805 - DNA, 2 bp, Artificial Sequence
  Description of Artificial Sequence: Synthetic oligonucleotide
tg

SEQ ID NO: 15806 - DNA, 4 bp, Artificial Sequence
  Description of Artificial Sequence: Synthetic oligonucleotide
tgtg

SEQ ID NO: 15807 - DNA, 2 bp, Artificial Sequence
  Description of Artificial Sequence: Synthetic oligonucleotide
tg

SEQ ID NO: 15808 - DNA, 12 bp, Artificial Sequence
  Description of Artificial Sequence: Synthetic oligonucleotide
tggggtaggttg

SEQ ID NO: 15809 - DNA, 2 bp, Artificial Sequence
  Description of Artificial Sequence: Synthetic oligonucleotide
tg

SEQ ID NO: 15810 - DNA, 80 bp, Artificial Sequence; identical to SEQ ID NO: 13586
  Description of Artificial Sequence: Synthetic oligonucleotide

SEQ ID NO: 15811 - DNA, 4 bp, Artificial Sequence
  Description of Artificial Sequence: Synthetic oligonucleotide
tgtg

SEQ ID NO: 15812 - DNA, 3039 bp, Artificial Sequence; identical to SEQ ID NO: 13608
  Description of Artificial Sequence: Synthetic polynucleotide

SEQ ID NO: 15813 - DNA, 2 bp, Artificial Sequence
  Description of Artificial Sequence: Synthetic oligonucleotide
yg

SEQ ID NO: 15814 - DNA, 9 bp, Artificial Sequence
  Description of Artificial Sequence: Synthetic oligonucleotide
ygttattyg

SEQ ID NO: 15815 - DNA, 36 bp, Artificial Sequence; identical to SEQ ID NO: 13631
  Description of Artificial Sequence: Synthetic oligonucleotide

SEQ ID NO: 15816 - DNA, 8 bp, Artificial Sequence
  Description of Artificial Sequence: Synthetic oligonucleotide
ygtygtyg

SEQ ID NO: 15817 - DNA, 181 bp, Artificial Sequence; identical to SEQ ID NO: 13653
  Description of Artificial Sequence: Synthetic polynucleotide

SEQ ID NO: 15818 - DNA, 369 bp, Artificial Sequence; identical to SEQ ID NO: 13664
  Description of Artificial Sequence: Synthetic polynucleotide

SEQ ID NO: 15819 - DNA, 2 bp, Artificial Sequence
  Description of Artificial Sequence: Synthetic oligonucleotide
yg

SEQ ID NO: 15820 - DNA, 35 bp, Artificial Sequence; identical to SEQ ID NO: 13686
  Description of Artificial Sequence: Synthetic oligonucleotide

SEQ ID NO: 15821 - DNA, 487 bp, Artificial Sequence; identical to SEQ ID NO: 13697
  Description of Artificial Sequence: Synthetic polynucleotide

SEQ ID NO: 15822 - DNA, 28 bp, Artificial Sequence
  Description of Artificial Sequence: Synthetic oligonucleotide
yggattaygaggttaggagattaagayg

SEQ ID NO: 15823 - DNA, 2 bp, Artificial Sequence
  Description of Artificial Sequence: Synthetic oligonucleotide
yg

SEQ ID NO: 15824 - DNA, 18 bp, Artificial Sequence
  Description of Artificial Sequence: Synthetic oligonucleotide
ygyggttaggaaggygyg

SEQ ID NO: 15825 - DNA, 18 bp, Artificial Sequence
  Description of Artificial Sequence: Synthetic oligonucleotide
ygtatttattgatttgyg

SEQ ID NO: 15826 - DNA, 87 bp, Artificial Sequence; identical to SEQ ID NO: 13742
  Description of Artificial Sequence: Synthetic oligonucleotide

SEQ ID NO: 15827 - DNA, 11 bp, Artificial Sequence
  Description of Artificial Sequence: Synthetic oligonucleotide
ygtaagtttyg

SEQ ID NO: 15828 - DNA, 2 bp, Artificial Sequence
  Description of Artificial Sequence: Synthetic oligonucleotide
yg

SEQ ID NO: 15829 - DNA, 167 bp, Artificial Sequence; identical to SEQ ID NO: 13773
  Description of Artificial Sequence: Synthetic polynucleotide

SEQ ID NO: 15830 - DNA, 2 bp, Artificial Sequence
  Description of Artificial Sequence: Synthetic oligonucleotide
yg

SEQ ID NO: 15831 - DNA, 2 bp, Artificial Sequence
  Description of Artificial Sequence: Synthetic oligonucleotide
yg

SEQ ID NO: 15832 - DNA, 2 bp, Artificial Sequence
  Description of Artificial Sequence: Synthetic oligonucleotide
yg

SEQ ID NO: 15833 - DNA, 185 bp, Artificial Sequence; identical to SEQ ID NO: 13777
  Description of Artificial Sequence: Synthetic polynucleotide

SEQ ID NO: 15834 - DNA, 17 bp, Artificial Sequence
  Description of Artificial Sequence: Synthetic oligonucleotide
ygttttgtttyggttyg

SEQ ID NO: 15835 - DNA, 135 bp, Artificial Sequence; identical to SEQ ID NO: 13779
  Description of Artificial Sequence: Synthetic polynucleotide

SEQ ID NO: 15836 - DNA, 2 bp, Artificial Sequence
  Description of Artificial Sequence: Synthetic oligonucleotide
yg

SEQ ID NO: 15837 - DNA, 71 bp, Artificial Sequence; identical to SEQ ID NO: 13781
  Description of Artificial Sequence: Synthetic oligonucleotide

SEQ ID NO: 15838 - DNA, 54 bp, Artificial Sequence; identical to SEQ ID NO: 13782
  Description of Artificial Sequence: Synthetic oligonucleotide

SEQ ID NO: 15839 - DNA, 5 bp, Artificial Sequence
  Description of Artificial Sequence: Synthetic oligonucleotide
ygtyg

SEQ ID NO: 15840 - DNA, 29 bp, Artificial Sequence
  Description of Artificial Sequence: Synthetic oligonucleotide
ygttttttttaygggtttaaaaatyggyg

SEQ ID NO: 15841 - DNA, 18 bp, Artificial Sequence
  Description of Artificial Sequence: Synthetic oligonucleotide
ygtagatattagaaagyg

SEQ ID NO: 15842 - DNA, 2 bp, Artificial Sequence
  Description of Artificial Sequence: Synthetic oligonucleotide
yg

SEQ ID NO: 15843 - DNA, 5 bp, Artificial Sequence
  Description of Artificial Sequence: Synthetic oligonucleotide
ygtyg

SEQ ID NO: 15844 - DNA, 24 bp, Artificial Sequence
  Description of Artificial Sequence: Synthetic oligonucleotide
ygagtttgygtaggaggygtttyg

SEQ ID NO: 15845 - DNA, 2 bp, Artificial Sequence
  Description of Artificial Sequence: Synthetic oligonucleotide
yg

SEQ ID NO: 15846 - DNA, 4 bp, Artificial Sequence
  Description of Artificial Sequence: Synthetic oligonucleotide
ygyg

SEQ ID NO: 15847 - DNA, 2 bp, Artificial Sequence
  Description of Artificial Sequence: Synthetic oligonucleotide
yg

SEQ ID NO: 15848 - DNA, 12 bp, Artificial Sequence
  Description of Artificial Sequence: Synthetic oligonucleotide
ygatttgtttyg

SEQ ID NO: 15849 - DNA, 2 bp, Artificial Sequence
  Description of Artificial Sequence: Synthetic oligonucleotide
yg

SEQ ID NO: 15850 - DNA, 80 bp, Artificial Sequence; identical to SEQ ID NO: 13823
  Description of Artificial Sequence: Synthetic oligonucleotide

SEQ ID NO: 15851 - DNA, 4 bp, Artificial Sequence
  Description of Artificial Sequence: Synthetic oligonucleotide
ygyg

SEQ ID NO: 15852 - DNA, 3039 bp, Artificial Sequence; identical to SEQ ID NO: 13845
  Description of Artificial Sequence: Synthetic polynucleotide

SEQ ID NO: 15853 - DNA, 2 bp, Artificial Sequence
  Description of Artificial Sequence: Synthetic oligonucleotide
tg

SEQ ID NO: 15854 - DNA, 9 bp, Artificial Sequence
  Description of Artificial Sequence: Synthetic oligonucleotide
tgttatttg

SEQ ID NO: 15855 - DNA, 36 bp, Artificial Sequence; identical to SEQ ID NO: 13868
  Description of Artificial Sequence: Synthetic oligonucleotide

SEQ ID NO: 15856 - DNA, 8 bp, Artificial Sequence
  Description of Artificial Sequence: Synthetic oligonucleotide
tgttgttg

SEQ ID NO: 15857 - DNA, 181 bp, Artificial Sequence; identical to SEQ ID NO: 13890
  Description of Artificial Sequence: Synthetic polynucleotide

SEQ ID NO: 15858 - DNA, 369 bp, Artificial Sequence; identical to SEQ ID NO: 13901
  Description of Artificial Sequence: Synthetic polynucleotide

SEQ ID NO: 15859 - DNA, 2 bp, Artificial Sequence
  Description of Artificial Sequence: Synthetic oligonucleotide
tg

SEQ ID NO: 15860 - DNA, 35 bp, Artificial Sequence; identical to SEQ ID NO: 13923
  Description of Artificial Sequence: Synthetic oligonucleotide

SEQ ID NO: 15861 - DNA, 487 bp, Artificial Sequence; identical to SEQ ID NO: 13934
  Description of Artificial Sequence: Synthetic polynucleotide

SEQ ID NO: 15862 - DNA, 28 bp, Artificial Sequence
  Description of Artificial Sequence: Synthetic oligonucleotide
tggattatgaggttaggagattaagatg

SEQ ID NO: 15863 - DNA, 2 bp, Artificial Sequence
  Description of Artificial Sequence: Synthetic oligonucleotide
tg

SEQ ID NO: 15864 - DNA, 18 bp, Artificial Sequence
  Description of Artificial Sequence: Synthetic oligonucleotide
tgtggttaggaaggtgtg

SEQ ID NO: 15865 - DNA, 18 bp, Artificial Sequence
  Description of Artificial Sequence: Synthetic oligonucleotide
tgtatttattgatttgtg

SEQ ID NO: 15866 - DNA, 87 bp, Artificial Sequence; identical to SEQ ID NO: 13979
  Description of Artificial Sequence: Synthetic oligonucleotide

SEQ ID NO: 15867 - DNA, 11 bp, Artificial Sequence
  Description of Artificial Sequence: Synthetic oligonucleotide
tgtaagttttg

SEQ ID NO: 15868 - DNA, 2 bp, Artificial Sequence
  Description of Artificial Sequence: Synthetic oligonucleotide
tg

SEQ ID NO: 15869 - DNA, 167 bp, Artificial Sequence; identical to SEQ ID NO: 14010
  Description of Artificial Sequence: Synthetic polynucleotide

SEQ ID NO: 15870 - DNA, 2 bp, Artificial Sequence
  Description of Artificial Sequence: Synthetic oligonucleotide
tg

SEQ ID NO: 15871 - DNA, 2 bp, Artificial Sequence
  Description of Artificial Sequence: Synthetic oligonucleotide
tg

SEQ ID NO: 15872 - DNA, 2 bp, Artificial Sequence
  Description of Artificial Sequence: Synthetic oligonucleotide
tg

SEQ ID NO: 15873 - DNA, 185 bp, Artificial Sequence; identical to SEQ ID NO: 14014
  Description of Artificial Sequence: Synthetic polynucleotide

SEQ ID NO: 15874 - DNA, 17 bp, Artificial Sequence
  Description of Artificial Sequence: Synthetic oligonucleotide
tgttttgttttggtttg

SEQ ID NO: 15875 - DNA, 135 bp, Artificial Sequence; identical to SEQ ID NO: 14016
  Description of Artificial Sequence: Synthetic polynucleotide

SEQ ID NO: 15876 - DNA, 2 bp, Artificial Sequence
  Description of Artificial Sequence: Synthetic oligonucleotide
tg

SEQ ID NO: 15877 - DNA, 71 bp, Artificial Sequence; identical to SEQ ID NO: 14018
  Description of Artificial Sequence: Synthetic oligonucleotide

SEQ ID NO: 15878 - DNA, 54 bp, Artificial Sequence; identical to SEQ ID NO: 14019
  Description of Artificial Sequence: Synthetic oligonucleotide

SEQ ID NO: 15879 - DNA, 5 bp, Artificial Sequence
  Description of Artificial Sequence: Synthetic oligonucleotide
tgttg

SEQ ID NO: 15880 - DNA, 29 bp, Artificial Sequence
  Description of Artificial Sequence: Synthetic oligonucleotide
tgttttttttatgggtttaaaaattggtg

SEQ ID NO: 15881 - DNA, 18 bp, Artificial Sequence
  Description of Artificial Sequence: Synthetic oligonucleotide
tgtagatattagaaagtg

SEQ ID NO: 15882 - DNA, 2 bp, Artificial Sequence
  Description of Artificial Sequence: Synthetic oligonucleotide
tg

SEQ ID NO: 15883 - DNA, 5 bp, Artificial Sequence
  Description of Artificial Sequence: Synthetic oligonucleotide
tgttg

SEQ ID NO: 15884 - DNA, 24 bp, Artificial Sequence
  Description of Artificial Sequence: Synthetic oligonucleotide
tgagtttgtgtaggaggtgttttg

SEQ ID NO: 15885 - DNA, 2 bp, Artificial Sequence
  Description of Artificial Sequence: Synthetic oligonucleotide
tg

SEQ ID NO: 15886 - DNA, 4 bp, Artificial Sequence
  Description of Artificial Sequence: Synthetic oligonucleotide
tgtg

SEQ ID NO: 15887 - DNA, 2 bp, Artificial Sequence
  Description of Artificial Sequence: Synthetic oligonucleotide
tg

SEQ ID NO: 15888 - DNA, 12 bp, Artificial Sequence
  Description of Artificial Sequence: Synthetic oligonucleotide
tgatttgttttg

SEQ ID NO: 15889 - DNA, 2 bp, Artificial Sequence
  Description of Artificial Sequence: Synthetic oligonucleotide
tg

SEQ ID NO: 15890 - DNA, 80 bp, Artificial Sequence; identical to SEQ ID NO: 14060
  Description of Artificial Sequence: Synthetic oligonucleotide

SEQ ID NO: 15891 - DNA, 4 bp, Artificial Sequence
  Description of Artificial Sequence: Synthetic oligonucleotide
tgtg

SEQ ID NO: 15892 - DNA, 3039 bp, Artificial Sequence; identical to SEQ ID NO: 14082
  Description of Artificial Sequence: Synthetic polynucleotide

SEQ ID NO: 15893 - DNA, 201 bp, Homo sapiens; identical to SEQ ID NO: 14093

SEQ ID NO: 15894 - DNA, 208 bp, Homo sapiens; identical to SEQ ID NO: 14094

SEQ ID NO: 15895 - DNA, 235 bp, Homo sapiens; identical to SEQ ID NO: 14105

SEQ ID NO: 15896 - DNA, 207 bp, Homo sapiens; identical to SEQ ID NO: 14116

SEQ ID NO: 15897 - DNA, 380 bp, Homo sapiens; identical to SEQ ID NO: 14127

SEQ ID NO: 15898 - DNA, 568 bp, Homo sapiens; identical to SEQ ID NO: 14138

SEQ ID NO: 15899 - DNA, 201 bp, Homo sapiens; identical to SEQ ID NO: 14149

SEQ ID NO: 15900 - DNA, 234 bp, Homo sapiens; identical to SEQ ID NO: 14160

SEQ ID NO: 15901 - DNA, 686 bp, Homo sapiens; identical to SEQ ID NO: 14171

SEQ ID NO: 15902 - DNA, 227 bp, Homo sapiens; identical to SEQ ID NO: 14182

SEQ ID NO: 15903 - DNA, 201 bp, Homo sapiens; identical to SEQ ID NO: 14193

SEQ ID NO: 15904 - DNA, 217 bp, Homo sapiens; identical to SEQ ID NO: 14204

SEQ ID NO: 15905 - DNA, 217 bp, Homo sapiens; identical to SEQ ID NO: 14205

SEQ ID NO: 15906 - DNA, 286 bp, Homo sapiens; identical to SEQ ID NO: 14216

SEQ ID NO: 15907 - DNA, 210 bp, Homo sapiens; identical to SEQ ID NO: 14227

SEQ ID NO: 15908 - DNA, 201 bp, Homo sapiens; identical to SEQ ID NO: 14238

SEQ ID NO: 15909 - DNA, 366 bp, Homo sapiens; identical to SEQ ID NO: 14247

SEQ ID NO: 15910 - DNA, 201 bp, Homo sapiens; identical to SEQ ID NO: 14248

SEQ ID NO: 15911 - DNA, 201 bp, Homo sapiens; identical to SEQ ID NO: 14249

SEQ ID NO: 15912 - DNA, 201 bp, Homo sapiens; identical to SEQ ID NO: 14250

SEQ ID NO: 15913 - DNA, 384 bp, Homo sapiens; identical to SEQ ID NO: 14251

SEQ ID NO: 15914 - DNA, 216 bp, Homo sapiens; identical to SEQ ID NO: 14252

SEQ ID NO: 15915 - DNA, 334 bp, Homo sapiens; identical to SEQ ID NO: 14253

SEQ ID NO: 15916 - DNA, 201 bp, Homo sapiens; identical to SEQ ID NO: 14254

SEQ ID NO: 15917 - DNA, 270 bp, Homo sapiens; identical to SEQ ID NO: 14255

SEQ ID NO: 15918 - DNA, 253 bp, Homo sapiens; identical to SEQ ID NO: 14256

SEQ ID NO: 15919 - DNA, 204 bp, Homo sapiens; identical to SEQ ID NO: 14257

SEQ ID NO: 15920 - DNA, 228 bp, Homo sapiens; identical to SEQ ID NO: 14258

SEQ ID NO: 15921 - DNA, 217 bp, Homo sapiens; identical to SEQ ID NO: 14259

SEQ ID NO: 15922 - DNA, 201 bp, Homo sapiens; identical to SEQ ID NO: 14260

SEQ ID NO: 15923 - DNA, 204 bp, Homo sapiens; identical to SEQ ID NO: 14261

SEQ ID NO: 15924 - DNA, 223 bp, Homo sapiens; identical to SEQ ID NO: 14262

SEQ ID NO: 15925 - DNA, 201 bp, Homo sapiens; identical to SEQ ID NO: 14263

SEQ ID NO: 15926 - DNA, 203 bp, Homo sapiens; identical to SEQ ID NO: 14264

SEQ ID NO: 15927 - DNA, 201 bp, Homo sapiens; identical to SEQ ID NO: 14265

SEQ ID NO: 15928 - DNA, 211 bp, Homo sapiens; identical to SEQ ID NO: 14275

SEQ ID NO: 15929 - DNA, 201 bp, Homo sapiens; identical to SEQ ID NO: 14286

SEQ ID NO: 15930 - DNA, 279 bp, Homo sapiens; identical to SEQ ID NO: 14297

SEQ ID NO: 15931 - DNA, 203 bp, Homo sapiens; identical to SEQ ID NO: 14308

SEQ ID NO: 15932 - DNA, 3238 bp, Homo sapiens; identical to SEQ ID NO: 14319

SEQ ID NO: 15933 - DNA, 201 bp, Homo sapiens; identical to SEQ ID NO: 14330

SEQ ID NO: 15934 - DNA, 208 bp, Homo sapiens; identical to SEQ ID NO: 14331

SEQ ID NO: 15935 - DNA, 235 bp, Homo sapiens; identical to SEQ ID NO: 14342

SEQ ID NO: 15936 - DNA, 207 bp, Homo sapiens; identical to SEQ ID NO: 14353

SEQ ID NO: 15937 - DNA, 380 bp, Homo sapiens; identical to SEQ ID NO: 14364

SEQ ID NO: 15938 - DNA, 568 bp, Homo sapiens; identical to SEQ ID NO: 14375

SEQ ID NO: 15939 - DNA, 201 bp, Homo sapiens; identical to SEQ ID NO: 14386

SEQ ID NO: 15940 - DNA, 234 bp, Homo sapiens; identical to SEQ ID NO: 14397

SEQ ID NO: 15941 - DNA, 686 bp, Homo sapiens; identical to SEQ ID NO: 14408

SEQ ID NO: 15942 - DNA, 227 bp, Homo sapiens; identical to SEQ ID NO: 14419

SEQ ID NO: 15943 - DNA, 201 bp, Homo sapiens; identical to SEQ ID NO: 14430

SEQ ID NO: 15944 - DNA, 217 bp, Homo sapiens; identical to SEQ ID NO: 14441

SEQ ID NO: 15945 - DNA, 217 bp, Homo sapiens; identical to SEQ ID NO: 14442

SEQ ID NO: 15946 - DNA, 286 bp, Homo sapiens; identical to SEQ ID NO: 14453

SEQ ID NO: 15947 - DNA, 210 bp, Homo sapiens; identical to SEQ ID NO: 14464

SEQ ID NO: 15948 - DNA, 201 bp, Homo sapiens; identical to SEQ ID NO: 14475

SEQ ID NO: 15949 - DNA, 366 bp, Homo sapiens; identical to SEQ ID NO: 14484

SEQ ID NO: 15950 - DNA, 201 bp, Homo sapiens; identical to SEQ ID NO: 14485

SEQ ID NO: 15951 - DNA, 201 bp, Homo sapiens; identical to SEQ ID NO: 14486

SEQ ID NO: 15952 - DNA, 201 bp, Homo sapiens; identical to SEQ ID NO: 14487

SEQ ID NO: 15953 - DNA, 384 bp, Homo sapiens; identical to SEQ ID NO: 14488

SEQ ID NO: 15954 - DNA, 216 bp, Homo sapiens; identical to SEQ ID NO: 14489

SEQ ID NO: 15955 - DNA, 334 bp, Homo sapiens; identical to SEQ ID NO: 14490

SEQ ID NO: 15956 - DNA, 201 bp, Homo sapiens; identical to SEQ ID NO: 14491

SEQ ID NO: 15957 - DNA, 270 bp, Homo sapiens; identical to SEQ ID NO: 14492

SEQ ID NO: 15958 - DNA, 253 bp, Homo sapiens; identical to SEQ ID NO: 14493

SEQ ID NO: 15959 - DNA, 204 bp, Homo sapiens; identical to SEQ ID NO: 14494

SEQ ID NO: 15960 - DNA, 228 bp, Homo sapiens; identical to SEQ ID NO: 14495

SEQ ID NO: 15961 - DNA, 217 bp, Homo sapiens; identical to SEQ ID NO: 14496

SEQ ID NO: 15962 - DNA, 201 bp, Homo sapiens; identical to SEQ ID NO: 14497

SEQ ID NO: 15963 - DNA, 204 bp, Homo sapiens; identical to SEQ ID NO: 14498

SEQ ID NO: 15964 - DNA, 223 bp, Homo sapiens; identical to SEQ ID NO: 14499

SEQ ID NO: 15965 - DNA, 201 bp, Homo sapiens; identical to SEQ ID NO: 14500

SEQ ID NO: 15966 - DNA, 203 bp, Homo sapiens; identical to SEQ ID NO: 14501

SEQ ID NO: 15967 - DNA, 201 bp, Homo sapiens; identical to SEQ ID NO: 14502

SEQ ID NO: 15968 - DNA, 211 bp, Homo sapiens; identical to SEQ ID NO: 14512

SEQ ID NO: 15969 - DNA, 201 bp, Homo sapiens; identical to SEQ ID NO: 14523

SEQ ID NO: 15970 - DNA, 279 bp, Homo sapiens; identical to SEQ ID NO: 14534

SEQ ID NO: 15971 - DNA, 203 bp, Homo sapiens; identical to SEQ ID NO: 14545

SEQ ID NO: 15972 - DNA, 3238 bp, Homo sapiens; identical to SEQ ID NO: 14556

SEQ ID NO: 15973 - DNA, 201 bp, Artificial Sequence; identical to SEQ ID NO: 14567
  Description of Artificial Sequence: Synthetic polynucleotide

SEQ ID NO: 15974 - DNA, 208 bp, Artificial Sequence; identical to SEQ ID NO: 14568
  Description of Artificial Sequence: Synthetic polynucleotide

SEQ ID NO: 15975 - DNA, 235 bp, Artificial Sequence; identical to SEQ ID NO: 14579
  Description of Artificial Sequence: Synthetic polynucleotide

SEQ ID NO: 15976 - DNA, 207 bp, Artificial Sequence; identical to SEQ ID NO: 14590
  Description of Artificial Sequence: Synthetic polynucleotide

SEQ ID NO: 15977 - DNA, 380 bp, Artificial Sequence; identical to SEQ ID NO: 14601
  Description of Artificial Sequence: Synthetic polynucleotide

SEQ ID NO: 15978 - DNA, 568 bp, Artificial Sequence; identical to SEQ ID NO: 14612
  Description of Artificial Sequence: Synthetic polynucleotide

SEQ ID NO: 15979 - DNA, 201 bp, Artificial Sequence; identical to SEQ ID NO: 14623
  Description of Artificial Sequence: Synthetic polynucleotide

SEQ ID NO: 15980 - DNA, 234 bp, Artificial Sequence; identical to SEQ ID NO: 14634
  Description of Artificial Sequence: Synthetic polynucleotide

SEQ ID NO: 15981 - DNA, 686 bp, Artificial Sequence; identical to SEQ ID NO: 14645
  Description of Artificial Sequence: Synthetic polynucleotide

SEQ ID NO: 15982 - DNA, 227 bp, Artificial Sequence; identical to SEQ ID NO: 14656
  Description of Artificial Sequence: Synthetic polynucleotide

SEQ ID NO: 15983 - DNA, 201 bp, Artificial Sequence; identical to SEQ ID NO: 14667
  Description of Artificial Sequence: Synthetic polynucleotide

SEQ ID NO: 15984 - DNA, 217 bp, Artificial Sequence; identical to SEQ ID NO: 14678
  Description of Artificial Sequence: Synthetic polynucleotide

SEQ ID NO: 15985 - DNA, 217 bp, Artificial Sequence; identical to SEQ ID NO: 14679
  Description of Artificial Sequence: Synthetic polynucleotide

SEQ ID NO: 15986 - DNA, 286 bp, Artificial Sequence; identical to SEQ ID NO: 14690
  Description of Artificial Sequence: Synthetic polynucleotide

SEQ ID NO: 15987 - DNA, 210 bp, Artificial Sequence; identical to SEQ ID NO: 14701
  Description of Artificial Sequence: Synthetic polynucleotide

SEQ ID NO: 15988 - DNA, 201 bp, Artificial Sequence; identical to SEQ ID NO: 14712
  Description of Artificial Sequence: Synthetic polynucleotide

SEQ ID NO: 15989 - DNA, 366 bp, Artificial Sequence; identical to SEQ ID NO: 14721
  Description of Artificial Sequence: Synthetic polynucleotide

SEQ ID NO: 15990 - DNA, 201 bp, Artificial Sequence; identical to SEQ ID NO: 14722
  Description of Artificial Sequence: Synthetic polynucleotide

SEQ ID NO: 15991 - DNA, 201 bp, Artificial Sequence; identical to SEQ ID NO: 14723
  Description of Artificial Sequence: Synthetic polynucleotide

SEQ ID NO: 15992 - DNA, 201 bp, Artificial Sequence; identical to SEQ ID NO: 14724
  Description of Artificial Sequence: Synthetic polynucleotide

SEQ ID NO: 15993 - DNA, 384 bp, Artificial Sequence; identical to SEQ ID NO: 14725
  Description of Artificial Sequence: Synthetic polynucleotide

SEQ ID NO: 15994 - DNA, 216 bp, Artificial Sequence; identical to SEQ ID NO: 14726
  Description of Artificial Sequence: Synthetic polynucleotide

SEQ ID NO: 15995 - DNA, 334 bp, Artificial Sequence; identical to SEQ ID NO: 14727
  Description of Artificial Sequence: Synthetic polynucleotide

SEQ ID NO: 15996 - DNA, 201 bp, Artificial Sequence; identical to SEQ ID NO: 14728
  Description of Artificial Sequence: Synthetic polynucleotide

SEQ ID NO: 15997 - DNA, 270 bp, Artificial Sequence; identical to SEQ ID NO: 14729
  Description of Artificial Sequence: Synthetic polynucleotide

SEQ ID NO: 15998 - DNA, 253 bp, Artificial Sequence; identical to SEQ ID NO: 14730
  Description of Artificial Sequence: Synthetic polynucleotide

SEQ ID NO: 15999 - DNA, 204 bp, Artificial Sequence; identical to SEQ ID NO: 14731
  Description of Artificial Sequence: Synthetic polynucleotide

SEQ ID NO: 16000 - DNA, 228 bp, Artificial Sequence; identical to SEQ ID NO: 14732
  Description of Artificial Sequence: Synthetic polynucleotide

SEQ ID NO: 16001 - DNA, 217 bp, Artificial Sequence; identical to SEQ ID NO: 14733
  Description of Artificial Sequence: Synthetic polynucleotide

SEQ ID NO: 16002 - DNA, 201 bp, Artificial Sequence; identical to SEQ ID NO: 14734
  Description of Artificial Sequence: Synthetic polynucleotide

SEQ ID NO: 16003 - DNA, 204 bp, Artificial Sequence; identical to SEQ ID NO: 14735
  Description of Artificial Sequence: Synthetic polynucleotide

SEQ ID NO: 16004 - DNA, 223 bp, Artificial Sequence; identical to SEQ ID NO: 14736
  Description of Artificial Sequence: Synthetic polynucleotide

SEQ ID NO: 16005 - DNA, 201 bp, Artificial Sequence; identical to SEQ ID NO: 14737
  Description of Artificial Sequence: Synthetic polynucleotide

SEQ ID NO: 16006 - DNA, 203 bp, Artificial Sequence; identical to SEQ ID NO: 14738
  Description of Artificial Sequence: Synthetic polynucleotide

SEQ ID NO: 16007 - DNA, 201 bp, Artificial Sequence; identical to SEQ ID NO: 14739
  Description of Artificial Sequence: Synthetic polynucleotide

SEQ ID NO: 16008 - DNA, 211 bp, Artificial Sequence; identical to SEQ ID NO: 14749
  Description of Artificial Sequence: Synthetic polynucleotide

SEQ ID NO: 16009 - DNA, 201 bp, Artificial Sequence; identical to SEQ ID NO: 14760
  Description of Artificial Sequence: Synthetic polynucleotide

SEQ ID NO: 16010 - DNA, 279 bp, Artificial Sequence; identical to SEQ ID NO: 14771
  Description of Artificial Sequence: Synthetic polynucleotide

SEQ ID NO: 16011 - DNA, 203 bp, Artificial Sequence; identical to SEQ ID NO: 14782
  Description of Artificial Sequence: Synthetic polynucleotide

SEQ ID NO: 16012 - DNA, 3238 bp, Artificial Sequence; identical to SEQ ID NO: 14793
  Description of Artificial Sequence: Synthetic polynucleotide

SEQ ID NO: 16013 - DNA, 201 bp, Artificial Sequence; identical to SEQ ID NO: 14804
  Description of Artificial Sequence: Synthetic polynucleotide

SEQ ID NO: 16014 - DNA, 208 bp, Artificial Sequence; identical to SEQ ID NO: 14805
  Description of Artificial Sequence: Synthetic polynucleotide

SEQ ID NO: 16015 - DNA, 235 bp, Artificial Sequence; identical to SEQ ID NO: 14816
  Description of Artificial Sequence: Synthetic polynucleotide

SEQ ID NO: 16016 - DNA, 207 bp, Artificial Sequence; identical to SEQ ID NO: 14827
  Description of Artificial Sequence: Synthetic polynucleotide

SEQ ID NO: 16017 - DNA, 380 bp, Artificial Sequence; identical to SEQ ID NO: 14838
  Description of Artificial Sequence: Synthetic polynucleotide

SEQ ID NO: 16018 - DNA, 568 bp, Artificial Sequence; identical to SEQ ID NO: 14849
  Description of Artificial Sequence: Synthetic polynucleotide

SEQ ID NO: 16019 - DNA, 201 bp, Artificial Sequence; identical to SEQ ID NO: 14860
  Description of Artificial Sequence: Synthetic polynucleotide

SEQ ID NO: 16020 - DNA, 234 bp, Artificial Sequence; identical to SEQ ID NO: 14871
  Description of Artificial Sequence: Synthetic polynucleotide

SEQ ID NO: 16021 - DNA, 686 bp, Artificial Sequence; identical to SEQ ID NO: 14882
  Description of Artificial Sequence: Synthetic polynucleotide

SEQ ID NO: 16022 - DNA, 227 bp, Artificial Sequence; identical to SEQ ID NO: 14893
  Description of Artificial Sequence: Synthetic polynucleotide

SEQ ID NO: 16023 - DNA, 201 bp, Artificial Sequence; identical to SEQ ID NO: 14904
  Description of Artificial Sequence: Synthetic polynucleotide

SEQ ID NO: 16024 - DNA, 217 bp, Artificial Sequence; identical to SEQ ID NO: 14915
  Description of Artificial Sequence: Synthetic polynucleotide

SEQ ID NO: 16025 - DNA, 217 bp, Artificial Sequence; identical to SEQ ID NO: 14916
  Description of Artificial Sequence: Synthetic polynucleotide

SEQ ID NO: 16026 - DNA, 286 bp, Artificial Sequence; identical to SEQ ID NO: 14927
  Description of Artificial Sequence: Synthetic polynucleotide

SEQ ID NO: 16027 - DNA, 210 bp, Artificial Sequence; identical to SEQ ID NO: 14938
  Description of Artificial Sequence: Synthetic polynucleotide

SEQ ID NO: 16028 - DNA, 201 bp, Artificial Sequence; identical to SEQ ID NO: 14949
  Description of Artificial Sequence: Synthetic polynucleotide

SEQ ID NO: 16029 - DNA, 366 bp, Artificial Sequence; identical to SEQ ID NO: 14958
  Description of Artificial Sequence: Synthetic polynucleotide

SEQ ID NO: 16030 - DNA, 201 bp, Artificial Sequence; identical to SEQ ID NO: 14959
  Description of Artificial Sequence: Synthetic polynucleotide

SEQ ID NO: 16031 - DNA, 201 bp, Artificial Sequence; identical to SEQ ID NO: 14960
  Description of Artificial Sequence: Synthetic polynucleotide

SEQ ID NO: 16032 - DNA, 201 bp, Artificial Sequence; identical to SEQ ID NO: 14961
  Description of Artificial Sequence: Synthetic polynucleotide

SEQ ID NO: 16033 - DNA, 384 bp, Artificial Sequence; identical to SEQ ID NO: 14962
  Description of Artificial Sequence: Synthetic polynucleotide

SEQ ID NO: 16034 - DNA, 216 bp, Artificial Sequence; identical to SEQ ID NO: 14963
  Description of Artificial Sequence: Synthetic polynucleotide

SEQ ID NO: 16035 - DNA, 334 bp, Artificial Sequence; identical to SEQ ID NO: 14964
  Description of Artificial Sequence: Synthetic polynucleotide

SEQ ID NO: 16036 - DNA, 201 bp, Artificial Sequence; identical to SEQ ID NO: 14965
  Description of Artificial Sequence: Synthetic polynucleotide

SEQ ID NO: 16037 - DNA, 270 bp, Artificial Sequence; identical to SEQ ID NO: 14966
  Description of Artificial Sequence: Synthetic polynucleotide

SEQ ID NO: 16038 - DNA, 253 bp, Artificial Sequence; identical to SEQ ID NO: 14967
  Description of Artificial Sequence: Synthetic polynucleotide

SEQ ID NO: 16039 - DNA, 204 bp, Artificial Sequence; identical to SEQ ID NO: 14968
  Description of Artificial Sequence: Synthetic polynucleotide

SEQ ID NO: 16040 - DNA, 228 bp, Artificial Sequence; identical to SEQ ID NO: 14969
  Description of Artificial Sequence: Synthetic polynucleotide

SEQ ID NO: 16041 - DNA, 217 bp, Artificial Sequence; identical to SEQ ID NO: 14970
  Description of Artificial Sequence: Synthetic polynucleotide

SEQ ID NO: 16042 - DNA, 201 bp, Artificial Sequence; identical to SEQ ID NO: 14971
  Description of Artificial Sequence: Synthetic polynucleotide

SEQ ID NO: 16043 - DNA, 204 bp, Artificial Sequence; identical to SEQ ID NO: 14972
  Description of Artificial Sequence: Synthetic polynucleotide

SEQ ID NO: 16044 - DNA, 223 bp, Artificial Sequence; identical to SEQ ID NO: 14973
  Description of Artificial Sequence: Synthetic polynucleotide

SEQ ID NO: 16045 - DNA, 201 bp, Artificial Sequence; identical to SEQ ID NO: 14974
  Description of Artificial Sequence: Synthetic polynucleotide

SEQ ID NO: 16046 - DNA, 203 bp, Artificial Sequence; identical to SEQ ID NO: 14975
  Description of Artificial Sequence: Synthetic polynucleotide

SEQ ID NO: 16047 - DNA, 201 bp, Artificial Sequence; identical to SEQ ID NO: 14976
  Description of Artificial Sequence: Synthetic polynucleotide

SEQ ID NO: 16048 - DNA, 211 bp, Artificial Sequence; identical to SEQ ID NO: 14986
  Description of Artificial Sequence: Synthetic polynucleotide

SEQ ID NO: 16049 - DNA, 201 bp, Artificial Sequence; identical to SEQ ID NO: 14997
  Description of Artificial Sequence: Synthetic polynucleotide

SEQ ID NO: 16050 - DNA, 279 bp, Artificial Sequence; identical to SEQ ID NO: 15008
  Description of Artificial Sequence: Synthetic polynucleotide

SEQ ID NO: 16051 - DNA, 203 bp, Artificial Sequence; identical to SEQ ID NO: 15019
  Description of Artificial Sequence: Synthetic polynucleotide

SEQ ID NO: 16052 - DNA, 3238 bp, Artificial Sequence; identical to SEQ ID NO: 15030
  Description of Artificial Sequence: Synthetic polynucleotide

SEQ ID NO: 16053 - DNA, 201 bp, Artificial Sequence; identical to SEQ ID NO: 15041
  Description of Artificial Sequence: Synthetic polynucleotide

SEQ ID NO: 16054 - DNA, 208 bp, Artificial Sequence; identical to SEQ ID NO: 15042
  Description of Artificial Sequence: Synthetic polynucleotide

SEQ ID NO: 16055 - DNA, 235 bp, Artificial Sequence; identical to SEQ ID NO: 15053
  Description of Artificial Sequence: Synthetic polynucleotide

SEQ ID NO: 16056 - DNA, 207 bp, Artificial Sequence; identical to SEQ ID NO: 15064
  Description of Artificial Sequence: Synthetic polynucleotide

SEQ ID NO: 16057 - DNA, 380 bp, Artificial Sequence; identical to SEQ ID NO: 15075
  Description of Artificial Sequence: Synthetic polynucleotide

SEQ ID NO: 16058 - DNA, 568 bp, Artificial Sequence; identical to SEQ ID NO: 15086
  Description of Artificial Sequence: Synthetic polynucleotide

SEQ ID NO: 16059 - DNA, 201 bp, Artificial Sequence; identical to SEQ ID NO: 15097
  Description of Artificial Sequence: Synthetic polynucleotide

SEQ ID NO: 16060 - DNA, 234 bp, Artificial Sequence; identical to SEQ ID NO: 15108
  Description of Artificial Sequence: Synthetic polynucleotide

SEQ ID NO: 16061 - DNA, 686 bp, Artificial Sequence; identical to SEQ ID NO: 15119
  Description of Artificial Sequence: Synthetic polynucleotide

SEQ ID NO: 16062 - DNA, 227 bp, Artificial Sequence; identical to SEQ ID NO: 15130
  Description of Artificial Sequence: Synthetic polynucleotide

SEQ ID NO: 16063 - DNA, 201 bp, Artificial Sequence; identical to SEQ ID NO: 15141
  Description of Artificial Sequence: Synthetic polynucleotide

SEQ ID NO: 16064 - DNA, 217 bp, Artificial Sequence; identical to SEQ ID NO: 15152
  Description of Artificial Sequence: Synthetic polynucleotide

SEQ ID NO: 16065 - DNA, 217 bp, Artificial Sequence; identical to SEQ ID NO: 15153
  Description of Artificial Sequence: Synthetic polynucleotide

SEQ ID NO: 16066 - DNA, 286 bp, Artificial Sequence; identical to SEQ ID NO: 15164
  Description of Artificial Sequence: Synthetic polynucleotide

SEQ ID NO: 16067 - DNA, 210 bp, Artificial Sequence; identical to SEQ ID NO: 15175
  Description of Artificial Sequence: Synthetic polynucleotide

SEQ ID NO: 16068 - DNA, 201 bp, Artificial Sequence; identical to SEQ ID NO: 15186
  Description of Artificial Sequence: Synthetic polynucleotide

SEQ ID NO: 16069 - DNA, 366 bp, Artificial Sequence; identical to SEQ ID NO: 15195
  Description of Artificial Sequence: Synthetic polynucleotide

SEQ ID NO: 16070 - DNA, 201 bp, Artificial Sequence; identical to SEQ ID NO: 15196
  Description of Artificial Sequence: Synthetic polynucleotide

SEQ ID NO: 16071 - DNA, 201 bp, Artificial Sequence; identical to SEQ ID NO: 15197
  Description of Artificial Sequence: Synthetic polynucleotide

SEQ ID NO: 16072 - DNA, 201 bp, Artificial Sequence; identical to SEQ ID NO: 15198
  Description of Artificial Sequence: Synthetic polynucleotide

SEQ ID NO: 16073 - DNA, 384 bp, Artificial Sequence; identical to SEQ ID NO: 15199
  Description of Artificial Sequence: Synthetic polynucleotide

SEQ ID NO: 16074 - DNA, 216 bp, Artificial Sequence; identical to SEQ ID NO: 15200
  Description of Artificial Sequence: Synthetic polynucleotide

SEQ ID NO: 16075 - DNA, 334 bp, Artificial Sequence; identical to SEQ ID NO: 15201
  Description of Artificial Sequence: Synthetic polynucleotide

SEQ ID NO: 16076 - DNA, 201 bp, Artificial Sequence; identical to SEQ ID NO: 15202
  Description of Artificial Sequence: Synthetic polynucleotide

SEQ ID NO: 16077 - DNA, 270 bp, Artificial Sequence; identical to SEQ ID NO: 15203
  Description of Artificial Sequence: Synthetic polynucleotide

SEQ ID NO: 16078 - DNA, 253 bp, Artificial Sequence; identical to SEQ ID NO: 15204
  Description of Artificial Sequence: Synthetic polynucleotide

SEQ ID NO: 16079 - DNA, 204 bp, Artificial Sequence; identical to SEQ ID NO: 15205
  Description of Artificial Sequence: Synthetic polynucleotide

SEQ ID NO: 16080 - DNA, 228 bp, Artificial Sequence; identical to SEQ ID NO: 15206
  Description of Artificial Sequence: Synthetic polynucleotide

SEQ ID NO: 16081 - DNA, 217 bp, Artificial Sequence; identical to SEQ ID NO: 15207
  Description of Artificial Sequence: Synthetic polynucleotide

SEQ ID NO: 16082 - DNA, 201 bp, Artificial Sequence; identical to SEQ ID NO: 15208
  Description of Artificial Sequence: Synthetic polynucleotide

SEQ ID NO: 16083 - DNA, 204 bp, Artificial Sequence; identical to SEQ ID NO: 15209
  Description of Artificial Sequence: Synthetic polynucleotide

SEQ ID NO: 16084 - DNA, 223 bp, Artificial Sequence; identical to SEQ ID NO: 15210
  Description of Artificial Sequence: Synthetic polynucleotide

SEQ ID NO: 16085 - DNA, 201 bp, Artificial Sequence; identical to SEQ ID NO: 15211
  Description of Artificial Sequence: Synthetic polynucleotide

SEQ ID NO: 16086 - DNA, 203 bp, Artificial Sequence; identical to SEQ ID NO: 15212
  Description of Artificial Sequence: Synthetic polynucleotide

SEQ ID NO: 16087 - DNA, 201 bp, Artificial Sequence; identical to SEQ ID NO: 15213
  Description of Artificial Sequence: Synthetic polynucleotide

SEQ ID NO: 16088 - DNA, 211 bp, Artificial Sequence; identical to SEQ ID NO: 15223
  Description of Artificial Sequence: Synthetic polynucleotide

SEQ ID NO: 16089 - DNA, 201 bp, Artificial Sequence; identical to SEQ ID NO: 15234
  Description of Artificial Sequence: Synthetic polynucleotide

SEQ ID NO: 16090 - DNA, 279 bp, Artificial Sequence; identical to SEQ ID NO: 15245
  Description of Artificial Sequence: Synthetic polynucleotide

SEQ ID NO: 16091 - DNA, 203 bp, Artificial Sequence; identical to SEQ ID NO: 15256
  Description of Artificial Sequence: Synthetic polynucleotide

SEQ ID NO: 16092 - DNA, 3238 bp, Artificial Sequence; identical to SEQ ID NO: 15267
  Description of Artificial Sequence: Synthetic polynucleotide

SEQ ID NO: 16093 - DNA, 201 bp, Artificial Sequence; identical to SEQ ID NO: 15278
  Description of Artificial Sequence: Synthetic polynucleotide

SEQ ID NO: 16094 - DNA, 208 bp, Artificial Sequence; identical to SEQ ID NO: 15279
  Description of Artificial Sequence: Synthetic polynucleotide

SEQ ID NO: 16095 - DNA, 235 bp, Artificial Sequence; identical to SEQ ID NO: 15290
  Description of Artificial Sequence: Synthetic polynucleotide

SEQ ID NO: 16096 - DNA, 207 bp, Artificial Sequence; identical to SEQ ID NO: 15301
  Description of Artificial Sequence: Synthetic polynucleotide

SEQ ID NO: 16097 - DNA, 380 bp, Artificial Sequence; identical to SEQ ID NO: 15312
  Description of Artificial Sequence: Synthetic polynucleotide

SEQ ID NO: 16098 - DNA, 568 bp, Artificial Sequence; identical to SEQ ID NO: 15323
  Description of Artificial Sequence: Synthetic polynucleotide

SEQ ID NO: 16099 - DNA, 201 bp, Artificial Sequence; identical to SEQ ID NO: 15334
  Description of Artificial Sequence: Synthetic polynucleotide

SEQ ID NO: 16100 - DNA, 234 bp, Artificial Sequence; identical to SEQ ID NO: 15345
  Description of Artificial Sequence: Synthetic polynucleotide

SEQ ID NO: 16101 - DNA, 686 bp, Artificial Sequence; identical to SEQ ID NO: 15356
  Description of Artificial Sequence: Synthetic polynucleotide

SEQ ID NO: 16102 - DNA, 227 bp, Artificial Sequence; identical to SEQ ID NO: 15367
  Description of Artificial Sequence: Synthetic polynucleotide

SEQ ID NO: 16103 - DNA, 201 bp, Artificial Sequence; identical to SEQ ID NO: 15378
  Description of Artificial Sequence: Synthetic polynucleotide

SEQ ID NO: 16104 - DNA, 217 bp, Artificial Sequence; identical to SEQ ID NO: 15389
  Description of Artificial Sequence: Synthetic polynucleotide

SEQ ID NO: 16105 - DNA, 217 bp, Artificial Sequence; identical to SEQ ID NO: 15390
  Description of Artificial Sequence: Synthetic polynucleotide

SEQ ID NO: 16106 - DNA, 286 bp, Artificial Sequence; identical to SEQ ID NO: 15401
  Description of Artificial Sequence: Synthetic polynucleotide

SEQ ID NO: 16107 - DNA, 210 bp, Artificial Sequence; identical to SEQ ID NO: 15412
  Description of Artificial Sequence: Synthetic polynucleotide

SEQ ID NO: 16108 - DNA, 201 bp, Artificial Sequence; identical to SEQ ID NO: 15423
  Description of Artificial Sequence: Synthetic polynucleotide

SEQ ID NO: 16109 - DNA, 366 bp, Artificial Sequence; identical to SEQ ID NO: 15432
  Description of Artificial Sequence: Synthetic polynucleotide

SEQ ID NO: 16110 - DNA, 201 bp, Artificial Sequence; identical to SEQ ID NO: 15433
  Description of Artificial Sequence: Synthetic polynucleotide

SEQ ID NO: 16111 - DNA, 201 bp, Artificial Sequence; identical to SEQ ID NO: 15434
  Description of Artificial Sequence: Synthetic polynucleotide

SEQ ID NO: 16112 - DNA, 201 bp, Artificial Sequence; identical to SEQ ID NO: 15435
  Description of Artificial Sequence: Synthetic polynucleotide

SEQ ID NO: 16113 - DNA, 384 bp, Artificial Sequence; identical to SEQ ID NO: 15436
  Description of Artificial Sequence: Synthetic polynucleotide

SEQ ID NO: 16114 - DNA, 216 bp, Artificial Sequence; identical to SEQ ID NO: 15437
  Description of Artificial Sequence: Synthetic polynucleotide

SEQ ID NO: 16115 - DNA, 334 bp, Artificial Sequence; identical to SEQ ID NO: 15438
  Description of Artificial Sequence: Synthetic polynucleotide

SEQ ID NO: 16116 - DNA, 201 bp, Artificial Sequence; identical to SEQ ID NO: 15439
  Description of Artificial Sequence: Synthetic polynucleotide

SEQ ID NO: 16117 - DNA, 270 bp, Artificial Sequence; identical to SEQ ID NO: 15440
  Description of Artificial Sequence: Synthetic polynucleotide

SEQ ID NO: 16118 - DNA, 253 bp, Artificial Sequence; identical to SEQ ID NO: 15441
  Description of Artificial Sequence: Synthetic polynucleotide

SEQ ID NO: 16119 - DNA, 204 bp, Artificial Sequence; identical to SEQ ID NO: 15442
  Description of Artificial Sequence: Synthetic polynucleotide

SEQ ID NO: 16120 - DNA, 228 bp, Artificial Sequence; identical to SEQ ID NO: 15443
  Description of Artificial Sequence: Synthetic polynucleotide

SEQ ID NO: 16121 - DNA, 217 bp, Artificial Sequence; identical to SEQ ID NO: 15444
  Description of Artificial Sequence: Synthetic polynucleotide

SEQ ID NO: 16122 - DNA, 201 bp, Artificial Sequence; identical to SEQ ID NO: 15445
  Description of Artificial Sequence: Synthetic polynucleotide

SEQ ID NO: 16123 - DNA, 204 bp, Artificial Sequence; identical to SEQ ID NO: 15446
  Description of Artificial Sequence: Synthetic polynucleotide

SEQ ID NO: 16124 - DNA, 223 bp, Artificial Sequence; identical to SEQ ID NO: 15447
  Description of Artificial Sequence: Synthetic polynucleotide

SEQ ID NO: 16125 - DNA, 201 bp, Artificial Sequence; identical to SEQ ID NO: 15448
  Description of Artificial Sequence: Synthetic polynucleotide

SEQ ID NO: 16126 - DNA, 203 bp, Artificial Sequence; identical to SEQ ID NO: 15449
  Description of Artificial Sequence: Synthetic polynucleotide

SEQ ID NO: 16127 - DNA, 201 bp, Artificial Sequence; identical to SEQ ID NO: 15450
  Description of Artificial Sequence: Synthetic polynucleotide

SEQ ID NO: 16128 - DNA, 211 bp, Artificial Sequence; identical to SEQ ID NO: 15460
  Description of Artificial Sequence: Synthetic polynucleotide

SEQ ID NO: 16129 - DNA, 201 bp, Artificial Sequence; identical to SEQ ID NO: 15471
  Description of Artificial Sequence: Synthetic polynucleotide

SEQ ID NO: 16130 - DNA, 279 bp, Artificial Sequence; identical to SEQ ID NO: 15482
  Description of Artificial Sequence: Synthetic polynucleotide

SEQ ID NO: 16131 - DNA, 203 bp, Artificial Sequence; identical to SEQ ID NO: 15493
  Description of Artificial Sequence: Synthetic polynucleotide

SEQ ID NO: 16132 - DNA, 3238 bp, Artificial Sequence; identical to SEQ ID NO: 15504
  Description of Artificial Sequence: Synthetic polynucleotide

SEQ ID NO: 16133 - DNA, 223 bp, Homo sapiens; identical to SEQ ID NO: 15522

SEQ ID NO: 16134 - DNA, 676 bp, Homo sapiens; identical to SEQ ID NO: 15528

SEQ ID NO: 16135 - DNA, 1238 bp, Homo sapiens; identical to SEQ ID NO: 15529

SEQ ID NO: 16136 - DNA, 220 bp, Homo sapiens; identical to SEQ ID NO: 15530

SEQ ID NO: 16137 - DNA, 631 bp, Homo sapiens; identical to SEQ ID NO: 15531

SEQ ID NO: 16138 - DNA, 223 bp, Homo sapiens; identical to SEQ ID NO: 15545

SEQ ID NO: 16139 - DNA, 676 bp, Homo sapiens; identical to SEQ ID NO: 15551

SEQ ID NO: 16140 - DNA, 1238 bp, Homo sapiens; identical to SEQ ID NO: 15552

SEQ ID NO: 16141 - DNA, 220 bp, Homo sapiens; identical to SEQ ID NO: 15553

SEQ ID NO: 16142 - DNA, 631 bp, Homo sapiens; identical to SEQ ID NO: 15554

SEQ ID NO: 16143 - DNA, 223 bp, Artificial Sequence; identical to SEQ ID NO: 15568
  Description of Artificial Sequence: Synthetic polynucleotide

SEQ ID NO: 16144 - DNA, 676 bp, Artificial Sequence; identical to SEQ ID NO: 15574
  Description of Artificial Sequence: Synthetic polynucleotide

SEQ ID NO: 16145 - DNA, 1238 bp, Artificial Sequence; identical to SEQ ID NO: 15575
  Description of Artificial Sequence: Synthetic polynucleotide

SEQ ID NO: 16146 - DNA, 220 bp, Artificial Sequence; identical to SEQ ID NO: 15576
  Description of Artificial Sequence: Synthetic polynucleotide

SEQ ID NO: 16147 - DNA, 631 bp, Artificial Sequence; identical to SEQ ID NO: 15577
  Description of Artificial Sequence: Synthetic polynucleotide

SEQ ID NO: 16148 - DNA, 223 bp, Artificial Sequence; identical to SEQ ID NO: 15591
  Description of Artificial Sequence: Synthetic polynucleotide

SEQ ID NO: 16149 - DNA, 676 bp, Artificial Sequence; identical to SEQ ID NO: 15597
  Description of Artificial Sequence: Synthetic polynucleotide

SEQ ID NO: 16150 - DNA, 1238 bp, Artificial Sequence; identical to SEQ ID NO: 15598
  Description of Artificial Sequence: Synthetic polynucleotide

SEQ ID NO: 16151 - DNA, 220 bp, Artificial Sequence; identical to SEQ ID NO: 15599
  Description of Artificial Sequence: Synthetic polynucleotide

SEQ ID NO: 16152 - DNA, 631 bp, Artificial Sequence; identical to SEQ ID NO: 15600
  Description of Artificial Sequence: Synthetic polynucleotide

SEQ ID NO: 16153 - DNA, 223 bp, Artificial Sequence; identical to SEQ ID NO: 15614
  Description of Artificial Sequence: Synthetic polynucleotide

SEQ ID NO: 16154 - DNA, 676 bp, Artificial Sequence; identical to SEQ ID NO: 15620
  Description of Artificial Sequence: Synthetic polynucleotide

SEQ ID NO: 16155 - DNA, 1238 bp, Artificial Sequence; identical to SEQ ID NO: 15621
  Description of Artificial Sequence: Synthetic polynucleotide

SEQ ID NO: 16156 - DNA, 220 bp, Artificial Sequence; identical to SEQ ID NO: 15622
  Description of Artificial Sequence: Synthetic polynucleotide

SEQ ID NO: 16157 - DNA, 631 bp, Artificial Sequence; identical to SEQ ID NO: 15623
  Description of Artificial Sequence: Synthetic polynucleotide

SEQ ID NO: 16158 - DNA, 223 bp, Artificial Sequence; identical to SEQ ID NO: 15637
  Description of Artificial Sequence: Synthetic polynucleotide

SEQ ID NO: 16159 - DNA, 676 bp, Artificial Sequence; identical to SEQ ID NO: 15643
  Description of Artificial Sequence: Synthetic polynucleotide

SEQ ID NO: 16160 - DNA, 1238 bp, Artificial Sequence; identical to SEQ ID NO: 15644
  Description of Artificial Sequence: Synthetic polynucleotide

SEQ ID NO: 16161 - DNA, 220 bp, Artificial Sequence; identical to SEQ ID NO: 15645
  Description of Artificial Sequence: Synthetic polynucleotide

SEQ ID NO: 16162 - DNA, 631 bp, Artificial Sequence; identical to SEQ ID NO: 15646
  Description of Artificial Sequence: Synthetic polynucleotide

SEQ ID NO: 16163 - DNA, 2 bp, Homo sapiens
cg

SEQ ID NO: 16164 - DNA, 5 bp, Homo sapiens
cgacg

SEQ ID NO: 16165 - DNA, 24 bp, Homo sapiens
cgaagcgcctcctgcgcagactcg

SEQ ID NO: 16166 - DNA, 2 bp, Homo sapiens
cg

SEQ ID NO: 16167 - DNA, 5 bp, Homo sapiens
cgtcg

SEQ ID NO: 16168 - DNA, 24 bp, Homo sapiens
cgagtctgcgcaggaggcgcttcg

SEQ ID NO: 16169 - DNA, 2 bp, Artificial Sequence
  Description of Artificial Sequence: Synthetic oligonucleotide
yg

SEQ ID NO: 16170 - DNA, 5 bp, Artificial Sequence
  Description of Artificial Sequence: Synthetic oligonucleotide
ygayg

SEQ ID NO: 16171 - DNA, 24 bp, Artificial Sequence
  Description of Artificial Sequence: Synthetic oligonucleotide
ygaagygttttttgygtagattyg

SEQ ID NO: 16172 - DNA, 2 bp, Artificial Sequence
  Description of Artificial Sequence: Synthetic oligonucleotide
tg

SEQ ID NO: 16173 - DNA, 5 bp, Artificial Sequence
  Description of Artificial Sequence: Synthetic oligonucleotide
tgatg

SEQ ID NO: 16174 - DNA, 24 bp, Artificial Sequence
  Description of Artificial Sequence: Synthetic oligonucleotide
tgaagtgttttttgtgtagatttg

SEQ ID NO: 16175 - DNA, 2 bp, Artificial Sequence
  Description of Artificial Sequence: Synthetic oligonucleotide
yg

SEQ ID NO: 16176 - DNA, 5 bp, Artificial Sequence
  Description of Artificial Sequence: Synthetic oligonucleotide
ygtyg

SEQ ID NO: 16177 - DNA, 24 bp, Artificial Sequence
  Description of Artificial Sequence: Synthetic oligonucleotide
ygagtttgygtaggaggygtttyg

SEQ ID NO: 16178 - DNA, 2 bp, Artificial Sequence
  Description of Artificial Sequence: Synthetic oligonucleotide
tg

SEQ ID NO: 16179 - DNA, 5 bp, Artificial Sequence
  Description of Artificial Sequence: Synthetic oligonucleotide
tgttg

SEQ ID NO: 16180 - DNA, 24 bp, Artificial Sequence
  Description of Artificial Sequence: Synthetic oligonucleotide
tgagtttgtgtaggaggtgttttg

SEQ ID NO: 16181 - DNA, 201 bp, Homo sapiens; identical to SEQ ID NO: 14260

SEQ ID NO: 16182 - DNA, 204 bp, Homo sapiens; identical to SEQ ID NO: 14261

SEQ ID NO: 16183 - DNA, 223 bp, Homo sapiens; identical to SEQ ID NO: 14262

SEQ ID NO: 16184 - DNA, 201 bp, Homo sapiens; identical to SEQ ID NO: 14497

SEQ ID NO: 16185 - DNA, 204 bp, Homo sapiens; identical to SEQ ID NO: 14498

SEQ ID NO: 16186 - DNA, 223 bp, Homo sapiens; identical to SEQ ID NO: 14499

SEQ ID NO: 16187 - DNA, 201 bp, Artificial Sequence; identical to SEQ ID NO: 14734
  Description of Artificial Sequence: Synthetic polynucleotide

SEQ ID NO: 16188 - DNA, 204 bp, Artificial Sequence; identical to SEQ ID NO: 14735
  Description of Artificial Sequence: Synthetic polynucleotide

SEQ ID NO: 16189 - DNA, 223 bp, Artificial Sequence; identical to SEQ ID NO: 14736
  Description of Artificial Sequence: Synthetic polynucleotide

SEQ ID NO: 16190 - DNA, 201 bp, Artificial Sequence; identical to SEQ ID NO: 14971
  Description of Artificial Sequence: Synthetic polynucleotide

SEQ ID NO: 16191 - DNA, 204 bp, Artificial Sequence; identical to SEQ ID NO: 14972
  Description of Artificial Sequence: Synthetic polynucleotide

SEQ ID NO: 16192 - DNA, 223 bp, Artificial Sequence; identical to SEQ ID NO: 14973
  Description of Artificial Sequence: Synthetic polynucleotide

SEQ ID NO: 16193 - DNA, 201 bp, Artificial Sequence; identical to SEQ ID NO: 15208
  Description of Artificial Sequence: Synthetic polynucleotide

SEQ ID NO: 16194 - DNA, 204 bp, Artificial Sequence; identical to SEQ ID NO: 15209
  Description of Artificial Sequence: Synthetic polynucleotide

SEQ ID NO: 16195 - DNA, 223 bp, Artificial Sequence; identical to SEQ ID NO: 15210
  Description of Artificial Sequence: Synthetic polynucleotide

SEQ ID NO: 16196 - DNA, 201 bp, Artificial Sequence; identical to SEQ ID NO: 15445
  Description of Artificial Sequence: Synthetic polynucleotide

SEQ ID NO: 16197 - DNA, 204 bp, Artificial Sequence; identical to SEQ ID NO: 15446
  Description of Artificial Sequence: Synthetic polynucleotide

SEQ ID NO: 16198 - DNA, 223 bp, Artificial Sequence; identical to SEQ ID NO: 15447
  Description of Artificial Sequence: Synthetic polynucleotide

SEQ ID NO: 16199 - DNA, 631 bp, Homo sapiens; identical to SEQ ID NO: 15531

SEQ ID NO: 16200 - DNA, 631 bp, Homo sapiens; identical to SEQ ID NO: 15554

SEQ ID NO: 16201 - DNA, 631 bp, Artificial Sequence; identical to SEQ ID NO: 15577
  Description of Artificial Sequence: Synthetic polynucleotide

SEQ ID NO: 16202 - DNA, 631 bp, Artificial Sequence; identical to SEQ ID NO: 15600
  Description of Artificial Sequence: Synthetic polynucleotide

SEQ ID NO: 16203 - DNA, 631 bp, Artificial Sequence; identical to SEQ ID NO: 15623
  Description of Artificial Sequence: Synthetic polynucleotide

SEQ ID NO: 16204 - DNA, 631 bp, Artificial Sequence; identical to SEQ ID NO: 15646
  Description of Artificial Sequence: Synthetic polynucleotide

SEQ ID NO: 16205 - protein, 393 aa, Homo sapiens [sequence omitted]

SEQ ID NO: 16206 - DNA, 2591 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 16207 - DNA, 106 bp, Artificial Sequence
  Description of Artificial Sequence: Synthetic polynucleotide
ttygtttttttatygtaggatgttyggyggttygggtatygygagtyggtygagttttagtyggagttaygtgattaygtttattygtatttatagtttgggtagt

SEQ ID NO: 16208 - DNA, 106 bp, Artificial Sequence
  Description of Artificial Sequence: Synthetic polynucleotide
gttgtttaggttgtaggtgygggtggaygtagttaygtagtttyggttggagttyggtyggttygyggtgttygggtygtygaatattttgyggtaggaggaygag

SEQ ID NO: 16209 - DNA, 25 bp, Artificial Sequence
  Description of Artificial Sequence: Synthetic oligonucleotide
ctcrtcctcctaccrcaaaatattc

SEQ ID NO: 16210 - DNA, 23 bp, Artificial Sequence
  Description of Artificial Sequence: Synthetic oligonucleotide
gttgtttaggttgtaggtgyggg

SEQ ID NO: 16211 - DNA, 59 bp, Artificial Sequence
  Description of Artificial Sequence: Synthetic oligonucleotide
tyggyggttygggtatygygagtyggtygagttttagtyggagttaygtgattaygttt

SEQ ID NO: 16212 - DNA, 59 bp, Artificial Sequence
  Description of Artificial Sequence: Synthetic oligonucleotide
ggaygtagttaygtagtttyggttggagttyggtyggttygyggtgttygggtygtyga
